United States Patent 10,407,724 (METHODS AND COMPOSITIONS FOR SCREENING AND TREATING DEVELOPMENTAL DISORDERS) - sequence listing, part 62

SEQ ID NO: 1717 - DNA, 1249865 bp, Homo sapiens
cttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacatttttggattgtttcattctttgcttgtcatttatctgttgattagaccactaaagtgaaggattcaagctaaatacatcaacctttctatttaggctttatcagctatatgtaaattcaattctatcaaaattttctgagtgcctcctcagtgtgtctctctgatggttcctgcccggtatggctggcatgaagaagatcctgtaaaaaagagaattcatttatttattcacttagtttgttcatgcatttgtttaataaatattgagatgtaccatgtgcctggcattgtggtaggtattgggaacacaggagtgagcaaaacaaaagtcttgctctactgcagttaagggccagggagaggcagaaaaagtaaataagtaaaatctatagtgaatttggtggtatgtacaagcggaggggaaggggttacggttttagatggactggctctttcagaagctgacacttgtacagacctgaaagatgtgaggaagtgagctatgcatctgtcgggaaaccattctgaaggatacagcaggtgcagactccagtgggatggttggtgtattctgggagcagccagacggcccatgtggctggagaagggtgagtgtgaggagtctaacaggagaggcagagaggaattggggtagcaccggaggctgcctcttaggccacagtaaggacttcacttttgactctgggagccagtgtaggagttttgagcagtggtctgatttaagctttaacgaatcacccaggcagtgggaatcaactgaaaggggaaccagtgagaagcttttgtaatcatccggacaaaatgaaggtgggccagactagggtggcagcagcagagcttgtgacaagttggattctggacatattttgaagataagagttaataggatttgctgatggattggataaaggttgtgagagagacaagaaaagaatgatgcaaggttttagcctgagcaactggaagaagagagttgccgtcagctgagatgaagacaatgaaagcagctttgcggacgcggtaagtttgagatgcccgttaacgagacatccaggtggggatgctgagtaggcgggatgcaaggctctggagttcatgggaaagctccaccaggaggtagaaatctgagagtcatcagtgaattgatggtatttaaaatcagaggagtagatgaaatcagcagtgaagtgggtgtagatagaaaagacagggggccccaagactgagtccagggcagtctggagatcagtgggatgagggataagcccaggagactaaaaaggaccagcagagactaagagttgcaaattagtgtggtaagtacagtgaatgcagcaggcatgggccccttaacgtcttcttgtctgtagtccttgatcagtctgctcattcacccacctatctatcctgtactccttgagcatctgcatgccaagcactgttttaagcagcagaggaagcaataagtaaatacatttgagttgttgagagatcatggggacaacagatgataagaaaacaggacagtatcagcagttgtcttatctgaaaaatgaggatccgttcctccctccagattgttgtaggatttaatgagataaagctcctgaagcacttatctcattgcctgcactaagagaccgctcaggggacattctgcaatgccatttgagctccctcctctttgcctggcaacagccccagctgccatctctgcctccagttgtgcccttctgcatgatctttccagagcactcatctgaatcacattaaacttctctgtttaaactttgtgtttacacttctgtttaaaccctggacctgctccaagttctcttctgtagctttgtgtacactgttttctctatgctgtcctctcaccgattttcttttccccgctaactccctatgtttcacaaattctttaagatgaccctcaagagctgaagggctgccctgccctctcctagcattctcttttctctgtcatggcttttgttgttttggaattgcttgcttattgaggtccccagtaaatcgtaagctccttgaaagccaggactgtatagagtctaacatgagcctagcattgcaatgagggcctcagtaaacacttgttggatgactggaattcatctcctgagttccatgggatgaatttgcccacgtgttcataacacagtctatgttcttcctttccataaggatatcatgaggctgtcaaatgaagatgtagcatatcaccagcattttatcttgccgttttagtttggcctttttctgtgaaacatcattaggggaaagtaaaactttacttggacaaaagaggtttgctaccaaattatataaaatgaataaacatatccctggagtgtttaagtcagcaagtatggccatctattattccacagacattttatattataatttactcactgaactttaacgaaggagaaaatgattttctaataattcttagtctttgaagattgtcactggaatacattccttgctcataaccactccccttgggaccgtggatatactatacagttattaaaatgcctgaattagaaaatctgctgctcttgggctatgagtttaactatagaagaattactgtatatgctcacacgagaggggcagaagaagggggtcacatttgagacgtagcagagaccaggcctttgaagtcctctggcatcaacaatgacttgctcctgagtcaaatgatgtgagaaaaccagaatttgggaaattttcatttcaattaagattcaggaaaatgagtcactggtgttctttgtaaattcatttatgaggtcaggcccccagaactgggaatgctccttatcacatagaaatgaatagaaaaatctgcctctgtaatttccatcacccagggctagaatatgtaactagagagggtggtcgaggcctgagtttgggtctgggggttcagagcaaccgatcaaactggaaaactgagcaggtgagtggagactcctgctgttctgaggagcacacgttcgcattcattcaaatgtttatcgccgctccactcgaggcactgcccaactctcatttatcttcacagaagttgagtggatctgcagactgcagcttcagtttttagatagaggaagaactaaaccccagcagctaatcggtgacaaagccagggctagaatccaaatctgctattctttatagatagaaaggccaagactcttaggcttgtaagtcacctgtcagtcacaactggaagtagaatactcctgggttcagtggcagatgacatcagcctaggggtcataaggcttggtttcactagctggggaaagtcatccaatagcttacgtgatggttttggagatgttcttatattcaccttcaattagcagtgagcccttcactaagcccttcatcttgggcttattgccctacttgctgtcaattaacctctggagacacaccaagtcttttagaaggaaggaagggagctactattttttgagggccttttatgtgccaagcccacaggctgggcattttccatacgttatttaactgaatcataacagtgctgcaaggtgttatctctttcataggtgtgcaaacagatgcagagaggttaggtttccagggccccacagccaagtggtggagctgggtttctggtccacggccttctgtctccactgggtgacactccctgtaccttctcattgaagcccctgggctagagggtccaagagcatcacttcagttctgcatttcattcgttactcacttgcatcaggacagatgcatcactactaagctctcggagaaggcatcagatgctgtctgctcccaaggagcttctacttttggtagtctgcttaacttgtatctgtgcctgtagagattgctctttgaaaaaagcagcaggaacattctgatagaagccaatggatgggacaggtggggggaatgcgttggatttgccagcacctggccactgcccaacctgctctcaattctcagatgattcaggtattgagcaaggaaggtagcagagctactgttgccttccctttggggaagcctgtttctactttgaaactcttaagggattcatttcaaattagtggcaggccttggttagtggatctgtgtgctgtcttctgccatcttgattgcatctccccccttctccttttcctttcatttgaaaaaagatgcagcccctcagagcctcactttcctgatttgtcaaatagggaacctaatgtacaaggcttttgtggggcttagaaaaaacatgtcaagaatctgatatagatctcaataaacagcataatacttatctttcgtcccagttacaaacccccattcctgtactgcccaaatctccatgattcacaaattgcgaccctgctgcttctgctccatggcagacacctagctccaggcaccctcctctaccacctccttctccttatggccattggcttttaggagacagacattgcttacttagcaggaaagctgtcacctgctttcttttgaactatcccgaacttgattctctttgggcgacgcatacacccatcaagtggtaaagaagactgggaatgaggggagaaaagaccctgggcttgttgctggggccagtagcttgggagtgtggtggtatgtgtgtggctttggctgtcaagtggatctaagttcaaccctggctacactgactttccagctgtgtgacttcagcaaatgggttaatctcctcaaggattcacttcctagggaggctttaaatgtccccgggtgattccagtgtgcagtggaggttgagagccagcgccctctactctcacccttgatgcccaaccaactcattgccagtctcctcctttagcacagcccatgatgctgcgatgtctgccaatgcagcatgcccctttgtgcctgctctgcccataacattctcaggagcttgctggacagcacagatgtttggtgtgcatattaacccagctgtggggatctttcctgctcaggtttggtggctaatttatagagcagctctgtcaggatgatcaccaatccctcttacaggcactgctttctctgttcaagtgtctcacatgtgtgtgcttgtgtttgccttttagctattactgtgatgattcccaatgtagtagacactgccagtgaccaccgcaatatccaatctcccccttttcctcactaacaacccctgcattgttgggggctgcagtgtgctcagctaaaactaacaattgcagccacattttccatcctcctacataggggtggccaataagctgtatgcagaagttgtggggtggagcttccaggaaagctcttaaaagtctgccttattcagctggacaatgcttccatcctatggtccttaccatcttttctaatgcctggaatatgtgtgtgctggaggatgctccagcagccattttgtgacaatgaggcaatcttgaggctaaaagccacttccaaaggatggcagagtagaaatatagaaggatcttgagatttcaatgatatcataaagctacaattccagctctgtactgcctatctctgaagttcatgttacatgagggaaaattcaacccctgcctcgtttaagacattgttattgctggtctttgctactagttctttagttcaattcctaactgatacttcccaaaacaaacctggtgaataacagcaattcaacaaatgtcaccgacccctgaatctctgcctcctccacccactcaccccagctacaaacactctttctttctcctgatgagtaaccgggcatctagctgtaaggttgctgaagctttgtggaatctcagaaagtcataaagctactgaacaagttcacaaacaagtgatgcatagaccacacccagcccacagatgagttctgtgtggctcacacttattttttaaaactgggtttgctgccaacacttcaaaacccaacgattttgcgtgaaaatccagatttcttagaaaatctgtggacccagggtcttcctttctgcctggcaacaatcagctggaactcagcagtggttgcccctgagatgaggcacagccccatccccctcactcatgtcacctgtatggcttggaaggcatgtgagtttgcaacctgctcaaacccacaccccagaaacggcccgctaaaatgggatttcagaatccacttgtacctttcttctttctcagtctcccctgactcaacacagcacactggcattgtttttttcctctcagacaactcagcatgcacttttgagaatcagagagaaatccgcctctcaaatgtcagaaaacagctgatgctgcctcttacttgggggccttttgacttcccacgtgtcttactgccacttgagagggagggctgcaggcaggcaggctccctggggagcagctgttgggatgcttgattgaggccctgagacagccagaggacaattaaattgggtattgaatatgaattgctttgaatggtttttattaccacattgtgagctgactttggttgtaaaatctgactccatctcttgctcttactgtggtgatgagacagaacttcaagatgtcttaaatagcagggcttggaacatgcatattagctcatctgtactcgtgaagtctgtcatctgatacccgcgctcctccactgtctgaaccaagttaggagccctgattaaacctccgcggctgcagtcgccaccttccgccggggtgaccccattggagatgacaaatgaaggatgtcttatttcagcctgatgtgtaagtcttcacagcactggtcgttaactactcttggaaagttaaatgcccatgcagctttttttttttttttccccaaacaaacataggtctctgaggttttggagagaaaaacaaaaactgttttaataataatttgtagctatgctttttgatgagttgcacactgagtgcaatatgttggctgcagaatgaccatctttgcagaagcaactctaaggaaagtgatgccacgctaagcacagagtgagttctcaataagtagaccgacttgagcggaagacagaaacagttaagtggagttggcatttccctggttggcaccaaggtctcagggttatttcgaccacaaaattaagttccagctcctagctactaacagagtcacaatatgcagcatggtgatggtcaaaaggcctgagcaagttcaaagcgccgtctctgccggctttggaaccggtttctgtgggaagcaggactctgttgctggggcaggcagatgcttgtgtccatttgcctagaggcagtaaatgtggggctggctggctggctgttggggagctaggactggaatatggggtgggccagtgggccttgctgcatgtagactctgtgctggctgtgttggctagttagttacccaactttatttcaaaaaatgtgtttcgaaccttcagatcgactagcctatctaaaaagagaacttagaaagttattttttttaaaaaaagtcttcttcctacggatttcctgaacatggccattatattctaattctcttgaggctagatcacttatcaaattttcatttcttttcagaagtaattaggagtgatgctaccttgaatccaggtgtgaatttttattgatttttgaggatttggccacgtgttcctttatccaagcctgtcttctgctccatcttatccaaacaaacattgaaccagcaatattcccaagtattccaacttgagaaaaatcttgtgtgtcttgagaaaaatcatttccatgacttattaatgaactaactagggataattttcatagggttcgttaactcagatttatcatagaatacaatttaataagaaacaattaaatggagtaattgaattcaagtccttttttgagtaatgatgttagcattcaatgaccccccctgcccatggttattgaagttatcaatgtatcaattttccccttgaagaaaatcagctgcaaatctcttcgtcaatgcatgggccgcctctcatctgccccctgcaggcctagcccttccttttcccgtccctgctctggtctatggggctgctgtgtgtatagaaaaaaatgaaaggactgatgaccatgtagataatgtttttccaaacataccatcgaggctgtgctacaaaagtgatccagtttggtggtcctttctcttttagagatgcctgttttgacaattcctccttacagtctgctttaatatttaaaagaaggcagtgggggctttaggttaaaattaaagtttcagaggcctgtgtatctttctcagactggttgaacttggaactgtgcaacttttctcaacaattttgccaattaaaaaagtccctttagctgtagatgctgagaaggctgggcctttggttctgctcctaaatgggagtggggaaggtgctcacagaacgatgccaagcaccactgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccggtggccctctcctgtgggacttgcgttccagctgttctcagagcgggtatgatcggcctccagtagacttggagggtcacgggtgagattttgataaggttcaaatactcctcactcctgcctccggtttccaccaaagttaccattgtactactaccaacagttgtggaaatttactttggcaaaggttttgtgtttttgtttgtttgtttttccccccaaaaattatgccaattaaatccgaccttaaatgacaaggcttttctctcatgtttaaaatcccatttttttccccttgccataaataaataaaaataacttgtggcttacaggctgcttaataccacaacattttaatgagcatgtcaggtaacccacaggcttcagttctttgttgcttacaagttccatccgtaagtgtgagttgctcacttagtctggggtaacaaccgcagattcccacagagaagaatcagtgtcttaaaacaaggtaataccaacccaatggtctatgaataggttggaatggcggtactttaagtaaaagtataaagaaatggttaacattatgaggaacttccagcagtactaataatcaaccctgttgttcaggagacattcacttgctaaactttaaggctaggcatttactgccttgaaagcaaagcaaatgaagattttgaccaactgcaacattcaggctctaaaatagaaatatgaatgaattattaaataataggtaacatttactgagcacttacgattttccaggcatctgtgcattatctcatttaattcttacaactctatgaaggtttcattatattatcctcactttacagattaaaaaaaaggcttagatctgcaactggtagttttggaagaacattcttttccttaaacaggaaactctaaatgccctctgttttgtccacctttgtgccactgtctgcttctgtgagggtcaggataatagtatacctgaaaccgcccttttagcaagcggcagggccaggacataagctcagactagatgtctaattcacttgctatacatgtaacatgtaaaataaaaaagacctgcatcttgactggtgtactctttgataaatgggacctgattacttgatggaggcatgtttgactatctttgtttatgacattagcaaactttcaatgggtttggaagtgaggctatttagttctgtgtcttactctgcaatccagacacctgtgacttgaggtaaagtaagtgttttcttggtttcccaatcatgagagtgaccgaagaatgacattttccaggtcatcattctcttgtggatattgttctctgataacaatattgggcaatctcaaagagctgtcatttcttggcagtgaactacaggctatttggaaaggaggtgtaaatcactttttcatcatgtccagtcctctgcactctagagtcatttgggatgttttgtgtctgcactacctctagagaatgatggaaatctaattctctgtcagcttttctacctggctagtgaaaatgcttcttgggagagctgggaggggaagtcgctgtccatggtggtcgttactgaagccccattcagcaaaatcggttcatactctaaatactggaatcctgcttaattaaactaaggagcttctgcacagcaaaataataaacagagtaaacagacaaccttcagaatgggagaaaatatttgctagctatgcatctgaaaaaggactaatatccataatcgataaggaactccaatcaacaagaaaaaaaaaagcattaaaaaccgggcaaaggacatgagcagacatttctcaaacgaagacatacaagtggccaacaaacacatgaaaaatgctcaccattgctaatcatcagagaaatggaaattaacagcacaatgagatagtctcacaccagtcagaatgactattattaaaaagtcaaaaaataacagatgttggtgaggttgccgagaaaagggaatgcttatacacaattggtgggaatgtaaattagcacaacccctgtggaaaatagtatagggatttctcaaagagctataaacagaactaccattcgacccagcaatcccaatactgggtatctactcaaaggaaaataaattgttatatcaagaagacacctgcacttgtatgtttattgcagcactattcacagtagaaaagatatggaatcaacctgtgtctatcagtgaatgcttgggtaaagaaaatgtaaatatacaccatgggatactatgcagccataaaaaagaatgaaatcatgtcttttgcagcaacacggatggagcttgaagccattatcctaagtgaaataaaaccagaaaatcagtaccacatgttctcatttacaagtgggaactaaacaataggtacaaatggacatacagagggaaacagtagacactgggaactccaaaagcagggaggatgggaggggactgaaactgaaaaattacctattaggtataatgtccactctttgggggatgagtacactagaaacccaacctcaccgttatacaacatatccatgtaacaaacctgcatctataaaaataaaaataaaaaataaacagctgttaattttgcaaaataagtaaatattacagtctggaaattaacttcatcatggcactaatgaaatttggtgatattctccagtactgtatattaaaacataaagatcttatcagtataatctactggttggagtaaaaacattaaataattcacaggagaatgactttttactctatggcactaaaatagcccctattcattgtcaaattttagatatttttaggtaccagaacagcataaaggggataaatcatttcctgaaaccctctcaccttacagcaaagaaaatagctacctatagaggttaaccaccataattagaagcaggcgtaaaaccatgaattcttgccacagaatcacttatcatgattctgtgatgcaccaggatattgaatgtcagaatcattctttcttcagtaatttcatttttttgcttaaaaacaatttccaatttatgtcatttgaaaaacagataatatatagtctgatgtaatatgtagctcatgttcatttatgtggagtgtatctaaatcttataatattctagctgtattaagtaatattgtttcctgcaaagtgagacagtagaaaaaactcttatggtaccaatttctgaccactgtaacccagtgaaaagcaaagcattaatttcattacaggtcatcaagaatgcaaccgtcaacataaactgcttatttaagagcagccattttctatcagaaaggactaatattaaaattccccactttcctatattctccctttgtattaaaaaattatccaggggaccatgttgaatattccagtctcaaaaatccaaagatggtggtaatttttctaagagatatgtaaggccctttgtaagatttagaggaataggattttaagagtttattcatttgtttagtagtagtataatgcaatagttaatctcctgactttggaataagacctgtggattcaagtcatgggtatttaacttaattgttttgtgatcttgagtaagttacttttttgagccatgctgttctaatttgtgatatgaatgtgataataatgtaagctacttcacaagagttgtggttggaaataaattagattaccaatatgtagtacttttcactaagtaccacactacttttcactaagtaccacacattggtaatatcatttggccaggttaaagtttccatttactcaatcaaagactaatctaggtgtttctgtgaaggtattttgtagatgcaattaaagtctatagtcagttgactttaactaaaggagattatcttagataatgtcattcaactagttgaaagtccttaagagcggcttccctgaagaagaaattccacctgtggacggcagtttcggctcatccacaagagttttcacctgcccttcctaatggcttgccttagctcagtcttgtccagccagtctccacaatcatgtaagccaattccttgcaataaatctttttgtatatgtctcctactggttctgcttctctgactgaaccccaactaacacaccatgtaaagcattaactatagtatctgtgacataataaacactccaaaatattagttaattttttaaattaacccttattgaacatctctcacatttatagcactgaggtatacactctgataaaaatgtctgagagctctgaaatagaatagggatagatagatacttattgtctccaatgatagtaacctcaaccaggaagggatttaatgttttagtaaaatttccaggaaaacaagggaaaagtgccaatgggttgattattccatctggagctatgtaggggaattatgcaaattcagtatgaggccagtttcctgggttaggaagacaatgaacaaaaaggcagttactgttttctcaacagatccatatagatgtagcacctgaaactagacacaccagtttccatggatcaaccatggaattccattctgtaagaaaaatttatttacgacttggtcttaagccaattggaattatatacttgataactgccttgagattcttggaggaagaaatacgctcatatttaagagtattaaagtaaaagatctttcttatttcaatgttagcttatcttagtattctacattgttagatctttgaatttgttttgtgcatttttaagcaaggaaaaaatacttatatcactaaaaagcaggcatagcacaaacctacttaaatagaatctgcctccgtccttcagaattataatgccaaacttacaaaacttaaggctggaaatatctcagatgagtaaacaaacctcagggaggtagtctcagatataaataggattaaaaggtgatgagaaagtaagagagagtgagagcatgccttttggttttatattaaagctctgataatttagagtgaatcttagaaatagaaatgttttaaattgtgtgtttgcaggtgtgtatgtgtgtattcactaaagacagctgtcccatgatcctttatgccataatagtaattttctcaaaggcagtgctattgctgtaaaaatacttttactcattatgcaaagatttattgaatacctgtgatgtcatatgtcgagctggttgctaagggataggaaagtaaattagagatggactctaatcttgtggaactctctctgggcaactctaatttatccttatggatttcaactaacacgtgactttctctaggaaatttttgtacttcccttgctctgcactggcctaggcagttctcttttgctctcacagtaactttgcttccactaatattgcatttatcattttttttagtaattagtcaattgcttataaatctccctataagactgcatgaggtcaaggaccttgtttatgtgaacctctatttttgctcggctcttgtcctcaaataggcattaggtaaatatttacagaacgagtgaaagaaagcttgggacatgttgaattttaattgctttccaaatagaaatatgcaggaagcagaaaatatataaacctggagctgaggacagagatgggtgcaagggatacaaatttgtattagctgattcctggtagttggaaggcctgggtggattatcttcaatgaggctcacatgtagaattatgaacgagaaagtctgaggtcaggactctggacagcgtccacactctccattttatctgtgggatgaaacatggcccacatggctaggatggaaatgttttgggaaacccaaagcccaaataaatcttttcaaccatgtgagtaagtttctaatagatatttcagaactaagttactgtagagacaggagcactataaatatggatttataatcatgacattgtggaactttacctcccaatatgtagagagcagggttttcaatttcgcaaaataaataaatgaataaatgttagcatatgttaatagagggcacaaaatagaagtcagagagagaaagagtgtctgtggggactcaacagactctgtgggaatcagactctctgattttctctctcaatggaatcaaggagtcccacgagttaggcattgggaaaggctctctgggtggtgaacagacatgtgtggctattggtggtgaatgtccaccacagaagcagcgtggctcttccttatactcaaggcttttttttgccattaatgagaagtaagacacagactgactcccagcacttaccaattttattattcttattgcctcctcatactttgccatgggaaaatccctgtttggatcacaaatttaaaacaatagactgcctgttaaccatgggcatatttacagatctgactatgagctaatacaacccagagtgagcagaagggacttatactttttcctgaaggcaagcaggcttggaatccaaggggaatgaatataaacactgagacccatctgccccagtcttctgaattaaaacctagggacttcttttgttaactctgttcaaggcccaaaccacatacagctccattgagccacagctaagatttttgcttgcagcctttgcttagaactggcccctgagagtcagtttcatctgtacagcacagttggtaagtacctcatccttcccacacctttaagcaacagaacagccacagtcaacacttacagcaactttcaaggttagcaatgaaagaagaaggctgcagtaacctcatctggatgcctgttttactaagtaattatacatcccaaatttcacaggacaaccttctttaaatgaatcagatcataaaatctgatttttcacttaggaaaatatggttaaatcatattagagactcatacttggagtcttcaaggaggtagcataatatacagaaaaaaagtccatggactccgaccgtggttcaagttcagctctatcatatttactggttgtagaccctgagcaacttgcttaacctgactgcacctcagtttctgcatctgtaaaatgaggataagtgttctttaaagatgttgtttaaggattaaatataagtacactcatataaaaatctagcacaatgcctggaccacaataattattcaaccagagaatcaagttcaccctagtacaaattcataagcattcagaatcaagaagttattccagcttatcaacagaactaaataataaagctcattcccacagcaccttctagtgtgcttatcagctgtgtaagtgaggaggagcccatgaacttgggaggggacagtaactttttatattgtagactcataaaaatgattttatttttttctctacaggatttttagaggacaaaatagtctctcatttgatggtgattatgtacattattatgataattctctaggaatgcacattaaggattttgaaatatattagaaggacaaaggaagaaagaatgacataataaatattaaaacataatttggggttgggataattgaatcttaggataaaatatggctgatggccattgttttttcctgctcaacacccggtgctctatttctgttaccaatagtctgatttgttactggggacccaactctcccacacttagctatgaaatcctagataatcaaccttaaaagagctggccatggagtggacccatgagccactggccaagcagaagattccatcatgcagccacagtggtttgttcagagacggtcagaaccaagactgttggaactactgggaaaaaggggaactcttctcactggggcttctgatgatgagcttggtattaccagggtgccaggtgtaatgcctggagctgccaagggccatcttgtggagagggtctacccaagagtgaagccagcgcagagaaaagcagagcagagatatggattggagtccagtgatagtttttgaggctctggatccagtcatgcctgaaacctttggactttatctcttatatgagccaataaatttttcattttacttcagccacttggagttggatttttggcagttgtaactgtaaagtgtcctgatttcttcagcagggaacttaagtataatttatctcaacctcccctctgatgtttgaatcttctctacaacttctaatgaaagagtcactcaatcaaggcttggactcctccagtgatagggagctcattaccaactgaagaagcccatccatctttgagacttatattactgcaaaattttttcttatatcaagtgaaggtttctgaaacctttgtaattaccacttattttgtacccagtagaggccagagaccctgtgctatgttatacttaaaaatatacattgtgatttaattctcaaattaaaaatttgaaaattttatttttgaaataatttaataaattaaattaataaaaattaatatctaatgatattaaaattattttagaagctgctgcacaaatccaagtgagaaatgatgagaggctgaagcaagggctatgggggtggggataaagaagatgaggagggatccagtgatgtacagatgtagcatacaggtgactgagtggagggtgagggcaagagtgaaacaggagacttggagggcctccagaaaatagacaggtgttgaaaagcagggagaaacaacctggatgggaaagatgaaggttctgctgtttatcccaagagttaccataagtcgaaggggtcactacttccaaggacacatgatagctctacaaatttctttaaaattttaactgaatctggtttagtgttaagaaataatcatgaacagaattggatgtgcatcaaaagcaaagttttagaaagacctgcaatttttgcacagacctttaatcacatgagtgcaagtcagaataacacttttatgttcagcccttaagactggtttctcccttctctcctcctgccagtgccccagaaggcagaggagaggatccagagaactcagcacgaagatgcagcagagtttgcctgagccacaggggatgggagtctgaccgtgaggtccaggaaccaaagagaagtgcattccagtggaatatgtttctaggaatgggaaagagggagaaagggaagaaacattttatgtatacctactatgtgccaggtcctttttatgtaggattattattattatttcagtatcactttttttttttcccaaatgtaaaaactgtggaggtctgcaaagttaagtaattttccaagatcaagcagcattagaattaagtccaggatgtatgtatgcctctgagatctgtaatttcttcattatgctatgctgtctccttaaataattagcagttataagacgcaagttataaggtgacaaaatacattgacatggtatctggattaacaacaacccagaaggctagtatttctaatattgtttctattttatagatgaggaaactgagtccctaagaggttcattgactagctcaaggccacacagctagtaagtagaaccatagctggaactaaaaattcccatctccaagatctgtgtattttcccatgacactgcagctactacgctgggcaagctactatgaagctggactttgtcagaacagtgacagataacagctttgctctgaaacgttctttccttcaaaggaacgcacccaacctaatgcttgtggtggcgcctgctttcacccacattggctcacaagagaaagactccaaggaaaaaaggaatgagggtccctagagtttctgatgagggtagggcggaggtgctttcaaggatggttaaccctctctcagggctgggcgcaaaggctcctgcctgtgatcccagcactttgcggggccgaggtgggaggactgcttgagttcaggagtttgagaccatcctggacaacatagcgagaccccatatctacaaaaaatttttaaaaattagcctggcatggtggtgcacacctgtagtcccagctgtccgggagggtgaggcaagaggatcacttgcgcccaggaagttgaggctgtagtgagccaagatcgtaccattgcactccagcctgggtgacaaagcaagaacctgtctcaaaaaaagagaagaaaaagaaaaaagacatgagacgtaggagccaggcatttttcagccacaaataccaagtggataaaaaaaaataatgaaaagaatagaagaatggttagcccactctctttctagtgaaccctgggataaggtctatggtgcagtgctgtgaaaattcactcaatccacgagatctatacactttgttgggacctgggatagaatgaaccagtgttcccttagaatggaaatgactgagtagaaataatgtgggaagccacattaactctttcaggccattaggctatcatttagtaaattactacattgttctaaatgggtccctagtgggtatggagggtgagaatgttctaatttgcttttctctcctttctctcagctgctttctcctactatgatgtagaacaagaagtggtttaataactgctctattccaaatcactgaatgctcttataactactgcataaaagtgcccctgcaggtctgctatattgaaatgtgtggaatcaaatctatgcatatgatatgaggggtgggggctgcaatctggtacccacaggatctagaagtaactcgaggaaccaggatatccctgattttaaattctaggttaatggagggcgtgtgaccgagagccccatgttcctggggagggaacagatgccactggaagctgcagggcaggagtttctccacctaaaagggaggatccacaactctgatctgaggaggagtccgtgtctctgccttggcatgtatattacaagagaaaatcataggaagggcaaggatgttccctgacgactggcttccctctgtcactcaggatgcatggccactgttggttgaaggaactatcatttttctccctgattgaaaaacaaaagaatcaaagctctcccttgtgcttacaaatctggggatattaattaaatacctagtagagatgctggggcctaatattattgcataatggtgattacagcaacaatgcattatatagcattaaatgtttttgaagcactttcatattcatttgttttttaaataatttttgtttttatttttttccagtttcattgaggtagaattaacaagcaaaacatgtacacctgtatgtattcaaggtgtatgatatgttgttttgacatacatacacactgtgaaatgatttccacaatcaagctaatgaacatatcatcccctcacatagttactctgtgtgtgtgtgtgtgtgtgtgtgtgtgtgtgtgtgtgtgtgtatgtatggtgagaatacttaagatctgctctcttagtgaatttcaagtatacaatacattattattaactatagttaccatgctatattattaggtctcctgaacttattcataactgcaagtttgtaccctttgtccaacatctcccctttgcatattcgttgttggtcagggctatcttgatggacatatgaagatgggctccatgcttggtttaattctctgcagtcacagtcttgtaattccaaataactttaacttggaattagtattttgtaagcaaggtctgatgggactgtggagcatgtgctgggcttggaacctcagcttgatgccgtcctgccttcctgggatgggtttttggctgccagctccctgtctcatgctggtcctgctcagggccctgcccactccacccccttaccccacaaccactgctgcaatcaggtggcactggcagggggaggaaagagaccagcttggattcagtccttgaccactctcttcccccaatggtggtggtgggggagtctcgacatggacggtcatccacctcatggctttttggggtaggcaaggcagcagccatccttgtccctaattgcaacatcatggcttgtttggtgggtgatatagtttggctatgtccccacccaaatctcatcttgaattgtagctcccataattcccacgtgctgtgggagggacccagtgggagataattgaaccaaactgtttaccccatactgttcttatgctagtgaatcagtctcacaagatctgatgattttataaggggtttccacttttgcttggctctcattctttctcttgcctgctgccatgtaagatgtgcctttgcttctcctttgccttctgccaggattgtgaggcctccccagccacatggaactgtgagtccattaaacctctttttctttataaattacccggtctcaggtatgtctttattagcagtgtgagaacagactgatacagggggcaatacagttggtgactctgcatgagtctttcacccatctctgactcaagtaccaagcacatcctggcctagggattgtaatctgttgggtagtcacctgtctgctgtgggttgggagtggtgggcctgtaggaaagggagattgacttccctgtccctggccaggcctcacagtttcattttataccaggccttgcaaaatatatagccagacctgtagttgacatttattgtaatatccatgcaagctggataggacaagaatgttgctactgttatgtctgcttccattatttctactgctggggaggctaccattaccttctctgtgacttgcacttgggcaagcacttaacaatatatcatcccatttaatcttcacaaccaatatacaaggtagggtttatacactggggtggttccctaacttctctgagttttagtttcctcatctggaaaactggtatcataatgcctacttggtaaggatattgtgagaattaaataagatgacatgtatattaagagatggaggtaattttatctacctgcattcctctaattctatatttgttaggaagaaatcttttggtaagctgcttgaggagaagagtcaccatggacagactaaaataacccaataagcttgcttaacttttgcacttatgacaaggagtagtgtttgttccttgccattgttcccaagaggaaggtggcaaagaaagagttggtgagggcgaagcatttgcaggggaagagaacaggagtgacagtatgtcctttagaaagtggaaatattgaatggggttctaaacaaattgtttggttgggtttatgctataaacagcccaacctacccaccgtcatgaaatcttcagtaaaggctgtgtagctgactaacgcttttgtgtgtgattagataaatgcgggagaggggctcagtgtctgttctcaaagaggcattgaaattcacatccacgttggcacaagtgaaaacagacagcttgtgccagaagatgagtgcagagctggtgtgtggttctaatactattcttggaatgcttcctctgagtgacctccctctctgttcaggccacgcatttctggagggtataacagcagtatattgttatattgtatatatatgtatattctgtttggtttctattcttccacaggccccaccatcaggttccgcacagagtgaacactcaaatgttgagggctgataaatgtgagtagcaactactaaatgaaggagatgaatatgcttttgtatagtaacttcaacgatgctttgatatagaaattagtttacctagtgtactgatgaggtacatgaggctcagagaggctaagaaacttgcctggcgtcacacagctagtaagcagcaaaaacagacattcatgttccatacacaatgccttcctggtcagtgacactttagcagactatctagagttctggcatcgtataaaccaggcattatccacatatgtatattttaaaacctcactgaaagcagaaggataagatgaattgactttaagcattcctggggaacaaaaagtcaaaatggaaaaggagaacaggagcataagaaaaaaatatatagcataactcgttatcccttagataactgtagggtcatgctgatattagtcattgtactgtgatgacaccaaaaagggaaagtgtaccagctagccaggtagatgcaattcattgtgcaagaaaaggctgcctcaaatgtgtctaaaagcgtggttcttcattcagccaagtcaagaccaaaggagcacatgaataattggctacagctcccctttcagcaagtaccagctttctctgctgaggctgatacagctccatacctcagggggccgggaatcagctgccagcagccaatgggcttctgagcattcataagcagaccaggtgctgatccatcaggctaattagcagcctgtgggccacagttagctgggaaggtggagggttttaactcttttcctgacagactccaagcctatctgggctttttgagcaatgttctatcagtcaaaccacaaagaaaagtattagaattcaaaaggagggaagctaaaaggaaatatagttttgctttaaataagacaagggagactaacaacacaaaggaagtgaactttgactctcaaatatacatatatatagatgtatatatgtgtctgtacgcatctcagtctacgtatcttcatgttactgactgtaatgtcatcaccacagcagacattcaatacatgtttgcttttgttgaggatgatatagtgatatttaaaacagaaataataaacaagggaagaaaataggacaggattgcaagggagggggatatttagcttgttggcacctgaaatgtatttaattatcaggctcccaaaagagcagaggaaacagaattagcttcaatgaaaaatacagagaacatgctgaaagttcagaaaaaatgcaaaacttactttaattaggagatggagatggaatacatcagaaatagtgtcactgcaaattaccagacttataaaccaatatgtaaatcagcagaggaaacaatcccatgaattttagtaaatttgtagaaacttgttgtaaatagtgcatttaaaattagttttaatgtgaaatagaatcaacaatcaatgaagccaacaccatccaaatgtcttcattgacataaaaggagcattctatagtcaattggttctatatttttgactttagtgtggttttgttgatcatggatccaataatctccagtgaagcagtgccaatatatgatctagcgataggaaataacaaacaagcatcctaatccttaaagtagccaaatctgacaatcatagaaaatggcaaggcaggatactggcaaaagtcttaaaacacagaggtaacatttatggagatgtctgcacgggctctctgtcaacatatggagaattgaggaagagctacgggatttcaatgacaagcccatcaccaccatctggagataaaaattctgtggtagattttttttttaaactgtgatattttactgataaattttatattagtgacaagatcctaaccaaagtttccttggactgcttactataaaactgtgtactattgactctggggttaaaaaaatggatttatgcctcactgagaaacagctgtcattgcatttgtagaatcatagtgtcaagatgatgaaactgagctaattccagagtcttcagggacctaaagaaagcattatacagccctgaggaggtttgggtgtactggcagtaatgtcaactgtatggccctgagaaactaatctccatgttgagattatgaacacaaatctttccccaaatatttactgagtaaaaacatagtgagtggtccattagggagagcaggagcatgagttggattgtttttgttctaagaaatgaatgcactaccttggactataatcaatttggggattgtggtcttttaaacagaccatagcagatgattcagtgtcagtgggccactggattcatgccaagtgataattctccataacgcttcctacagtctggtgtgtgcaaaacaggcaaggtcacaagtctgttctacagccaccgggtgtgctggtccttttattgtcctggcaaagtaacaaccctgtgtatgcacccctacaaactatctccccatggtttggtcagagctgacccccaagctcaccctgcctaagtcatttattactagcagaggaagaaataagcatataatcatgaccttatctacttctctagcctcaaatctagtctctcctcaatcaaaccctttcctatccctcagggacaccttgactgggtgcctttgcctgtgggactctctgcccttagcatctttcaattagttctctgcctggaaggctgttcttctttcatgtgttacctcctcctgaaatggtttcttgataataacagcaaacacataggatttgcttcataccaggcgcacttctaaatgctttattaaatgtacttacttctcaccagaaccctttgaaataggtactgttatagtctctactttagatataaagaaacttaaaggcagagttgttaagaaatttactcagggtcactggtaaatggtagagctgaggttatgaaccatggcagcctggctccagagtgtctgttcttcatcacgactctgagcataatgatccctagactttgctgttagtatcctgagcactcgctaccagagaagtagctgcactgcactctagtcatgtttgtaagcttcctctctttccatgctaactccagttaatccaacaacactcagccaaagcatcaactttttcccccttaagtcttcctgatcctgctcccctaacctgtgggaggtgaatcctccactgcccacaccatgcttctctctgctagactccttatcacaccacgtgtcttgtttacctgtctgcctccctcattaatctgtgaactctgaagttttgaaggcacgaatggtctcagtaacacagtatctggcatatagaactgttgcttaataaatatttgtctgtttgatggatggagactggtgctaacaagtcttcattttgcaactctggtttctagcttttaccggcagattaagaacaaaagggattccatcacaaatcctgggagaatcatgacaaatgcttagcttcagttcagaaagaagcaagactatttatagctcagggactcaacattaaatgacccggacttaatttttccttgtgacctagatttgcacaactttagatggaaagtgcccttggagatcattttacccaggtattgcaaactggtggcctagagttgtttttatttgacatatattatttgtttctatttttattagaatacctttagacaggacatgtgctttttatttctccacattttacatcatatcctatcatacaccactttactcatttgtattatccacctgaccattcaaagcatttgaatatgaaatgtctgaattagtctaactcattttttttggtctttgtttacagtaaagctcccaagtctgtacttagggtctccaattttctcattaattcattccagtcagatgttctcccaccctctactgatgtgtagactgatttccatgtaacaatgtaccaatcatgtaccagtgatttccacctagctaaatccagttcctagcttggacctcaacccctcctccttgacattcaggaccatactctcctggttttcctcctacttctctggcctccccttctctgtcttcttgctgattcctcctcatactctcgacctctaaatgttggatcctccaaggtgcagctcgtggcctgcttctcttctggatctactctcatccccttggggatcttgtacaggctcatgagtttaaacactgcccacatgttgacacttcctcagtgtacatctccagctcacttggttgtctagtgggcctgtcaaacttaatatgtctaaaaacaaactgccaatttcttcatattttttttgttgttgttgagatggagtcttgctctgttgcccaggctggagtgcagtggtgcaatctcagctcactacaacttccacctcctgggttaaagtgattctcctgcctcagcctcccgagtagctacgatgacagacgcgtgccactaccacacccatctaatttttgtatttttagtagagacaaggttttgccatgttggccaggctggtcttgaactcttgacctcaggtgatttgcccgccttggcctcccacaaactgtcaatttctaccccaaacctgctcttcttagcagttttctttatgtcagttaggggtatatccgggccaccagttgctcaggccaaaatccatgggcttatctctcattgcttcctttctatgtgatatggtttggatatttttcctcttcaaatatcacgctgaattgtaatccccggtgttggaggtggaatctggtgggaggtgtttggatcatggcggcggatcccttatagacggcttagctctatcctcttggtgatgagtgagccatgagatctggttgattaaaagtatggtacctccccactctctcttgatcctattactatgtgacatgctggctccttgtcaccttttcagccatgattgtaagcttcctgaggcctcaggagaagcacatgccagcaccattcttcctataaagcctgctgaaccatgagccagacaaacctcttttctttataaattacccagcctcaggcatttctttatagcaacacaagaacagtctaacacactttcatatgccatatacaagtcctcagcagtcatgtctactccaatcttccagtgcctcccttgttctttaagagtaaaagccaaagaaagtccttagagtggtctctaggagccttgatattctaccttccttccttattcctatccctacctttatttctcagacccccattcccaccactatcccccttattgacctgcctccagctcactggcctcccttcactgttgagtgaacactccaggcatttttctacatcggggtgtttgcatttgctgttccttctgcctggaatacccccacccttcccttccccatccccaggtatctgcatgtatctgcatgggttgcttcctcatttccttcatgactactcaaatgaacctcctcactgaagctttccttgaccactctatttgaaatagacttccctaagccaggatgatttttcatccctcctttctgcttttctctagagcactttattaccctctaatatcctatatattttacttacctattttgtttctcttcctactagaatgtaagctaaatgagggcaggcttgtttgtcttctttgtttactgctacatcctcagcatcagaataaggctgagaacttgttatgggttgaattatgttccccccaccacccccagtaagtcccagtgaccttatttgggaacgaggtcattacagatgtaattagttaagatgaggtcacactggagcaggctggacccctaatccaatatgactagcgtccttctagaaagaatggcatgtgaagagaaggagatatccatagagggaagatgatgtgaagatgtacagggagaagatggccatctacaagccaaggagagagatctggagcagatctttcagacttgatttcagacttctaagacttctagcctccagaactgtgagacagaatttttttttagacagagtctcactctgttgcccaggcaggagtacagtggtgtgatctcagcttactgcaacctccgcctcccaggttcaagcgatcctcctgcctcagtgccctgagtagctgggactacaggcatgtatcatcacacccagctaattttttgcatatttagtagggacgggctttcaccatgctggccaggctgatctcgaactcctgatctcaagtgatccacctgccttggcctctcatagtgctgggattacaggcatgagccatcgtgcctggccaagacaatacatttctattgtttggaccaacctgggtgtgttactttatcactacagccctagcaaactaatactcaaaaaaattctcaagaaaaatgtatgggtgaataaacaagtgaattaatcctttcaatgaagaaactgaaggccagtgaagttgattaacttgccagaaacacaccatggtgaacgggcagaaccaagactcaaatccagctttcctgccgccccatctagctctcagccaccacatctggatgccacgtcagtctgtctcatgagcactaacaatggtgggctgaggttgagggggatctccggagccccttcaccatctcctaggtcttgcctatcctgccttcctgcttaacgctcccaccaccatcacataacctggatatgttgtggccagacaattattgacgtatgtttgttaagtgttctgatctcctctcagaggaaaaccctgtgtttgactcttctattattcaggaagtaataaaagttatagtcataatatataagaaaaaagaatgattcactgctgagctactgagctacagggagcaatccaaggtttagaacagacaattggctaagatcagtcacgatgatgtcacagcggaatatacaaatacctcagtgggctgatccaagagaacatcacaattaaatcagcttactgctgagcactcttccacatctgtgaagagctgctctccattctgacagccacgtttaaggaggtggtggaggcggcagtctatccaacaccctccacacaggaagaaaggattgcaaagtgctactgagtaaatgaacatcattcacatggaaatgcactggacgagatcatacatgttaagacagttaacagacaggttaggaacaatgttttcttttcagaatggaattacagtatgacattgggcatgggaaactgatgagagccatcagagatgatattcaaaatgtttaacaaaatatcgacagcataagccatcaatggccaatgcagccttatcaatgcagagtggttgaacatggtgctggtgaaactcacttggctagaatagcagagatgccattaacctctctgacccttagtttagtttcttcattgcagagtgaggcaccaccacttatttcctagtgttgttacaaaggttaagaaaaaaatctgtgccacaattcctggtacatatcagatccccaataataagagcaaacatttatgtgtctttattatatataaggtattagcaaatgctaatttacttaacccttatagcagccctagtattcaactattttttttttttttttgagacaggatctcactctgtcaccctggctggagtgcagtggcacaatcacagctcactgcagcctccacctcccgggctcaagtggtcctcctgtctcagcttcctaagtagctggtgctacagatgtataccaccatgcccagttaatttttaaatttttcgtagagacagggtctcactatgccacccaggctggtcaagaactcctgggctcaagcaattattattagcattttcccgttggagaaattgatatagagagcggttaagcaactttctcaatgtcacactgctggtgaatggcaagacagggtcttaggacccaggtagaatgaatcccaggggctccttccccaccctatgctaccctcaggaaatgtcggggcccatccctcccactttatgctccagagagccagtgtccctgcaaacctaacatctcattgcctcaaagtcccagctaaagcctagtggagaggacatcactctttggtccttcagtgccctagcccttctttctaggtttactcaatttccatttgcatgaagacagacaagaaaaacagtccaattaatacgaagcgtaagaccacaagatgagaaggcttttgctttgctttttattttgtatcagctgaagtgctgtgagtattcgggatgaaaaattatttatcccagttaatgaatctcatgataataaaaatgcctgacagctctgagattagtgagtagcccttatctggggaccacttagtgaagcaaatcctgcgtgaacaaaggacaaatgggatttgggagaatgaggaggaagggaggctaagaacgaacatgtgttttgcagctatctcatgccaggcatcacacaaggtactcaaccctcattctttcttttaattcttttgagaactcagtctttatacaaacacttatggcagtgccaggtaccataataagtgttggggttacaaaattaaataaatcatggcccctgtccttttaagtagaatggatacagaaaataagtagagaggctatttatgttcactgcaatattagtttgatatgagtatacacaggcagtggaactatgctatacaggccaagatgatacctaccatgtcaatagttcctgcataaggactatttcctgcatacgcagctgtgttctgggctgggtgatatacccctgcacctccccatggcccctcaggcccttcacggaggttagttggctagaggagtgagattctcttaggagtttacacttggaagcagaaagagaatcaggcaattggttgtgggaacagaaactgagaagatgatctaaaaggagtgatgaagtacagtagaatggggctgggtgggaccatgtgtaagcggaagctatgaatacacagaagatacaaggcacagaaaacgctgagcagaatgtgaggaagctaggtcgtagcaggaaatgaatagaagcagaggatactctaaccaacgtatgccccacaatttaatcctttccctaatgttagatcattctcattttttcctgtattacaaggaatcctatgatgaatatcattgcacatcagtatttgtagcatttctgatgagtttctctaatatattcttggattaaatggtatgcacattttaatgctcttgagacaagtatgcatctttatttccaggaagatagcactaatttcccacgcccttcagtattatatgagtgagtctactttaacacattgtctcacactgagtccttgtcacttaaacagggaacggtagtaactacctttttaattgtttaattatttaatttttaattgtttgcatatttttcatatgttatgggacatttgtatttcctcttttgtgactccagcttgtttatgtctttttgtccatttgcctataaggccatttataatgctcttattgatgtatgagaaatcaataaaatttatataacaagaccaatactcactgacatatttagcaaacacttacccataattagttgttttccttttcatttttatttgaggcacggaagttttatatttttcaatatattgatattttcctttgtaatttgtttcaaagggtttctttttgcggaaaaaaatctttttctgttttctagatcaggaaaatacttggctctgtttcttttcctacttttggaaaatgtttttgcttttatatttaacttttctgttcacttacaatttattttggtgtatttgaacctttatgaaggaagattttgtactaaattaaaaaagaggatggtgtgatcctgtttcagaaaaatctaatctgtgttaatgtttgttccccagcagaatcaaccatggattacttccaatgaccagtgcaatgacttgagcacacacagacccatttaaatacataatgagggagaacatatgatcaagggcggagatgccatcatttgtgctctgtatacaacctacttttattaaatggaaattatggtcactgaataactcaatctacctaaactcttacaaggaatcagaagccctcagttcttaagctgggtctgtactgatttacaatgggacacaaacacactgtacctccttaaccctaacacccactttccaattgcctgtctttcaaaactatctaattagatttctttaaaaagaacatttttgtcatttgtgaggaatttttcttttcttttttagtttgctcttactgaaaaaccaaggcaacttcaactttatcttttcatagggtccctttccaagtgttatgactgaatggaagctgtgtggttggtgaagtacttcggctatatttccaaaaatatgcaattgttaggggctgcaatgcaacagccagttccagagactagcaaaaggcagggggatactctcaagagtgactacactcgagactttccatttcagcaacttcaggaattggggaaaactcactaattcaacactgagttctctgaaagtgatggtgtattagtttgctaggtctaccataacaaagtacagcaaattgggtggcttaaacaacagacatttgttttctcagaactctggaggccagatattcaagatggcagcactggggagaaaatctagcttctggtggtttgcaggcaatctttgacatttctttgcttgcagaaacatgaccacaatatctgtcttactcttcacatggcattctctgtaaagccacactatttgcttagattgtttgaagaaggcactttcagatgtgttccagaggctgggcaccttgatctggatcaaacgctgccaattgttggttgaaggtgagtgtagaaatgtatctacttccaaagccaaaatattactgtattagtccgttttcatgctgctgataaagacatacctgagactgggtaatttatacaggaaaaagggtttaacggacttacagttccacgtggctgggaggcctcacaatcatggtggaaggaaaggaggagcaagtcacatcttatgtggatagcagcaggcaaagagagagcttgtgcaggaaaactccaccttataaagccatcagatcttgtgacatttattcactatcacgagaacagcacgggaaggacctgcacccatgattcagttacctcccacctggtccctcccacaacatgtgggaattcaagatgagatttgggtggggacacagccaaaccatatcaattactaagtacacagaaaaatttataagtcttggtccatgtacctcatcaacttcttctagcaagaagcagctggctgacttgcaatgaaatctccttagagttttatctttaaatcattgatctcaatggatatcttatacctgaaaatttgctgttttactaagggtgaagtaaattaaattccacaagagttagaaaataatttaatcagctggcaaaagctaaggatgaaagcaagttaatacaaatttcaattttcaaacaagattcaatacatgtatataatttatttggctagattcaatacatgtatataatttatttggctattacagggagagaaaacataattactaggtcttattaaaagtatgtctttcttcttttccctgtcatcctttcttccctttcttctttcatttttaaattcccttcccctcttcctcattccttcctcctttcttttcttcttccctcccttgatgttttccatttactcagaaaacatttagggagcaattaccacaagttagagtatacaccatatgccaaggatgcacccaaaatgtacaggtgataaagcagcagttcctgccctcagcaagttcatagcctaatagaatctgagttatgtaagggtgaaggccctacagtacattctctataatattgtagtaagaggaataatctcagatctcatgcatgcattccatgatttttctctttacttttgccactgtttttctacctgatattaatcttaatactataatcttatactactccttcaagcagctccgtgtgttttctataggcccaccaattattgccatgttctaataaggttttaaagaaaatatgtgaccctttagaacatcaccccacttccatgcctgtcttccatcctctgtataaagagcagagggtgtgaagaatggactagaagggttcctgggtggctcattgttgtgatctgtttgcctgctttggcatgctttgattataataaatatcttctctgaggggagcattttgaggaaagtgattgtaaaagaagatggaaatccatctataaagatggtaaccacaggaactaatttgaagaggtttttcatatttattaatagcatagaattgtccttccagaaagcataaagttctaaatttgaacaaagtccacagtctgaaccaaaattctgtacctttcagaatggatcataaaagaaaaaaagtctacagcacaaaaatagtttcctcctataacctcaaacaaatgtgagggcgatctgcccttgcaattttcattacttcaagataacaacaaggaaactatgattcagttagttctttcctttcacacattcagagttactctgcaattgctgagtgctagtgtatctatcctcaagtggcatttctgtttgagaactgtatttttcattatttagagttttctgtaatttttactggtaatattaatatttaacaatatcatacccccagaggtatctttgtgcaactttagaatatacgtactttgtttctttttatgactctaaccttttattctttcattcctctagtactctgaatataagagagtctacacgctttttagtgaggattttttgatccctgcttcataagtgtcactcattgtaggctttcctttgacaacaaaaattcctgctctctttacgttgactctaattacttcaccagaaaaggtaaacctgtcattgtgtaagaaaaggaattaagttaatgtaactgtttcttaaggtcttattattattttatttttatttttttgagacagagtcttgctgtgtggcccaggctggagtgcagtggcacaatctcggctcactgcaacctctgcctcctgggttcaagcgattctcctgcctcagcctcccgagtagctggaattataggcatgcaccaccacgcctggctaatttttctatttttagtagagatggggtttcaccatgttggccaggctggtcttgaactcccgacctcaggcgatccacccacctcagcctcccaaagtgctgggatgacaggcatgagccactgtgcctggctcttaagggcttaatgtgaatgttgcatacacatgtaatttctgattcatttgtggacctttgcgtaaaaataaaattttcttagaaattcatagaaaaacatggcagttcttaccatgcatcacagtcaatttcctgagggttctgttctttggagtctggggaggggaggtgctgtggtttggatgtgtttttttcccaccaaagcccatggtgaaattcaatcctcagtgtggcagtgtggggagatagggcctagtgagaggtgtctgggtcatagaggtatatccctcatgaatagattaatgccttcctgctagggtgagtgagttctagctctcaggggaatgggttagttcccttgaaagtgagaatgggttgttaaaaggagtctggcttccttggttttgctcttttgcttcctttctcagcctgtgatctctgcacactttggctctctgtcactttccaccatcagtagaagcagcatgaggccctcaccagacacagctgcctaagcttggggtttccaggatcatgagccaaataaacctcttttctttataaactacccgtctcaggtagtctgttctagcaacataaaacagactaagacagaggtcttcaataccaaaagatagtctacttgatgtgtgaagggaggctttggtttgcctgctataaaataattttagttgatgaacccgaagttccctgaaggtttagtttctggtgactttcattctgcaattcttgcacaaatggaaaaaaatccatcctagttgaatggagtacctacactacaaatgtagagtgaatctgtagaaaccactttttagataactgataaaccagctagttgctaatcacttcattgctgcttcccaccaccagtcaatgtttaaaaaaaataaagaattctccacctaactttgacaactggggaaaggtaggactttgtttcagcatcaaaaggaagtagagccacgtagaattatcatttagttccctcagtcatagccatttctcatttttcatcttccctacttttctcagggccatttattgtcctctaatgcctcccttctcttcattcttttttgctcttaatatctctggagggacaccaaagaagtgatttctttctgcattcattaaaaataggtttatgttttgccttcctgttcaattcccacttgggctgtaagcaagtaactaaagcaagggaagggttgggcatgtgggcgccagacttagatgcctctatttatgcctagattcttcctatttctcccattcttccctcaggataggagaaaaaggaggtggcagaggtctgattaaagcagggatgagcaactgagccaccactgcagtgctgagattgggtgaagcccccagcttcacagaaaggcctgcaacatcattgcaagattaaatgtgccaatattcttgctaagttactactttttgcacattaccagagaatagacttcccgggcctaaaggaatggcaatgttttcattgtcatttatttctctgttcagtaaggtagatagtacaggttttaagagtcttcttttttttcctcatgagactctatttcttttcccctctattttcttctatgctaaatggctgtatctactcttgaaaatacattctaactctaagtgtcctttgtggatttgactttaggaaaccaaagtagcttcccccaagccaccctctgtctctcttttttgtttttttgcccattggtcgattttaccttctttttgtataccatcaacccaaagacacagcatactagggacgtaagtgtggaactgataccgttagttttatttcggggtgatgcaatccctctgctaattcttagatggtcttatggtgtcagaagaaaatttccttctgtcagaaagccttaagtacgtttggaaaataattcagaatcaaggctgtcttcttctgttttttaatcaattcactaaatagtcttcatcatacagagaaattattccttctactccactccaaactaagacattattttgaaatagattatcaaataatagtgcagactaatttccatagctcaatgagtagaaggcaaagtacattatttgctaatgcaaatgctgagccttctccaaaaaatttaatattcaaagtccagacgggataaggagacaaaaaaagattgcttaacaattttccaaaccaaagtgacctataacacacaaaatatggttctattatgtgcaactgatattttctttgttgagaataatgagctacagcagaatggcataatgtagaactccacagctgataagctttctgcataagaacaggaagaggacatttcttaaagagttctgtgttcattgcttaccttgaggaggcagtgaatggaattactgttaatagtaacaatatgaagctaattggtttaaaatgaagcagcaggaaatgctgatgatgagactggggtatatgaaggaagaatgaaaaatctatactccggctacacaaaaatgatgcttaaaatgtaacttaatcttgatattttattcataaatgacaaatctgctcactacactgattccctaggtgactcatcaaatcccatctctaggtttatgaatctcaaaattttgtagctagttctgactgttttcactggcaaaatttgtcaaaatcaacttcttaagaatttggaaattaacccaaagtttgcaataatacaaaaagcatttacttttttaaaaaatggctgaatcccagtaaaaacagtgagctttgtggcattttaacttgcacttataaccatctgcctctccacagcttcacagtatccttgaaaatcaacagctttgcagccatgatagctatgaaaactagcagcctagcagccactggaggggacaggtcaggtatgaagctcccccaaaattcccattcccagagaatggtcactatttaacctgtctgaaagttccttaagaaagctccattcttatagtttgtctttatttgccttgacttaaagctcatttggtgggaatagccctgaccccagctaattttttgaaataatcagcaaaaaagctttcagaatagtgacactaattgaaactaaaaaaagaatgaccaaaaatttcacaggaaagactggataatgagatgtgtttaggggggtttgaaaagctctgatagatttctggtaatctagaaggccatgcacatatacagggctgtgcacgttcccagaaaagacctgagaagcccctattctctcatctctagttgactttgaggttctgtgcaagctggatgtgaaggctaaggcagagttgtaaactgcctggtagagcattgaagacacaccttaatacacacacatagtcctttggcagtggctgggagacttactggctcaaggcatttaaggaaatctgttcaatcattaggtaattggtaagctaactgagcacagacttctgtggatgcagtgagagataacacagaatttacagaattagtccaggaaagtcactaaacaaacagcagctgcaataataaagggcatcaacaacagaccttagagaggagggaggaatatgaattccagaattgccacactatattccttaaaatgtatagcattcaacaagaagttaggagacatgtaaataaaaagcaaagtatggcccatacacaggaaaaaaggaagtcaatagaaactgtccatggatgttggacttcctagacgaagactttaaaccatctatcataaatatgttcaagttactataggagacatgtctaaagaattaagggaaagtatgaaaataacgttttggcaaatagagaatgttaacaaaggatataaatgatttaaacgtacaaaatcggaattgtggagctgagcagtgtaatagctgtgataaaaatatagtggggctcaacagaagaaagaataagcaaacttgaataaaggccaattgagatgaataaatagaagaacagaggaaaaaagaatgaagaaaaacagtatcaaagacctgtgcagtgccatcaaatgtaacaacacatgcatagtgagagtcccagacagataagagaaaaaaaggggatgaagaatatttgaagaaataacagctgggaactctccaaacttgatgaaaactattaatccacacatgcaagaagcccagtgaactccaagtagggcaaactcaaagagatccttactttactacattacagccaaactttctacagctaaagacaaaaagagaatcttgagaatgccaagagaaaagtgactcattgagttcaagggatcctaaataacattaacagccagcttctcaacaaaaaccatgaaatccagaagaaaaaggaatgacctattcaaagtgccaagaattttacatccagcaaaaccaccagttaaaaacaaaggagaaattaagacatcctcagataaactgagggaatcttatcactagcagatcttgctccacagcagatagtaaggggaaaccttccgggggaaatgaaaggatgctggacagtaactcaaatccacatgaaaaaataaagagtaccagtacaagtaactgcatttgtaaatataaaagacaatataaacacatttttgcttgtaactctttctaatttaaaagacgaatgcaaagcaatgatgacaagctgtttgataggcttataatttataaatatatacttttttaattgaaatttttttcttttatcatccagcccaaaatgtcataaagatataatttctatgacaataataacacaaaggaggagaaagggaatgaagctatattgaagcagttttacatataattgacggtaaattggtattaatccaaactagattattttaagttaagatgttaattgtaatctctaaggcaaccactaagaaaataaagatatagtaagagaaacaagaaaattaaaatagtatactagaaaatttatatgttaaaaagaagaaaacctcaagtcaataactaaaacacacctcaaggcactggaaaaagaagagcaaattaaacctaaagcaagaagaagaaaggaaataataaaaataagagtagaaataaataatttagagaacagtaaaacaatagaggaaatcaacaaaaccaaaagtgtattctttgaaaagatcaagaaagttaaattaacaaatctttacctagactgaccaagaaaaaaaaaagactcgaatttcaaattattaaaattaggactgtaagaggggatattggctgtgcagaaataaaacaaaagattataagggaatgccatgaacaactgtatgccaacaaattaaataatcttggtgaactgaacaaatacctaaaaaaccacaaactgttgaaaccaactcaagaaaaattcaaaaatcttaatataacaaggatagagattggattcgtaattaaaaaaaaaaaacttcccacaaagagaagtctaggccaaaatggccttattaatgaattctaccaaatacttaaagaattaacaccaatttcataagttctaccaaaaaatagaaagggaaggaatacttctgaactgattctatgaggccagtatacactgacaccataatgagacaatgacatcacaagaaaataaaattaaagatcaatatatcttatgcatattgatgcaacaattctctagaaaatatcagcaatctgaatccagaaacatattaaaagaattataaccatgatcaagtgggatgcatcctgggaatgcaagatgtatttaacatacaaacataaatcataaatcaatgcaatactttaaattaatatataaaatgacaaaaattacgttatgagcacaatagatgcaggaatctcctttaacacagcccaatactcttttatgataaaaatcattcaacaaaccaggaaaaaaacacagaacttcctcaatctgataaagcccagccatatatagaacccatacggctaaaataatacttaatggcgaaagaccagatgtttttccctttcccaagacaaagctagctactctggtcacttctattcaatatagtattgggggtgctagccaggctaattaggcaagaaaaagaaatcaatgcatctagcttgaaaaggaagaagtgaaactatctctatttgcagattacgtgatcgttatatagaaaaccctaatacacacacacacacacacacacacacacacaagttcagcgaggtttcctgatacaagatcaatacacaagcattagttgtatttctgtgtattgacaatgaacaatttggaagtgaaattaagacaaaaattccttatagaatagtatcaaaaagaaaatgcctagtaatagatttaaaaaagaaatgcaatactttcacactgaaaactaaaatatcattgcaagaagttaaagaaaaactaaataaatggaaagaaaactcatgttcatgtatcagaagactgaatacgtgaagatggtaatactcccccaaattgatctacagattcaatccaatacctattagtatctcagctgccttatttgtagaaattaatgagctgatcctaaaattcacatggaaatgcaaaggacccaagatagccacaaaaatcttgagtaagaagaacaaagatgaagaactcatacttcctgatttcaaaacctgatacaaagctacagttatcaagacagtataaagcataagaacagtattggtataaggagagacatataaatcaatgaaaataatttatattttcagtagttcagtagcaggcttttacagggttaactgattttcagtaagagtgccaaggtaatccaatggaggggaaacaggctcttcaacaaaagttctggacaactgaatatccacattcaaaggaatgaagttgtaccagctcacatgattcacaaaaattaactcaaaatgaatcataggcctaaatgaaaatgctaacactataaaactcagaagaaaacatagaagaaaatcttcagaatcttggatcaggcatgacttcttagcaatgacactgaaagcacaagtgacacaagaaaaaatatataatggacatcatcaaaattaaaaactttttgtgattcaaatgatattatgaagaaagtaaaaatacaatccacaaaaatggagaaaatatttgtaaatcaaatatctgataagggttttctattccaggtatataattaattgttatagctcaacaataaaagataagtgacccaattttaaaatgggcaaaagatttgaatagacatttctccaaaaaatatatgcaaataaccaataaacacatgaaaagttacacagcctcactagtcatcagggaaatgcaaataaaaaccacaatgaaataccacttcattcctactaagatggctaaaataaaaaagaccataacaaatgctgacaaaggtgtggagaaattgtaactctcatatgttactggtgggattataaaatggtgaagccactttggaaaacagttcagcagttcctcagaaagttaaatttagagttaccatatgatccagcaattccactcctaggtatacacccaagagaattgaaaacatatgtggatacaaaatttgtacataaatgtttctagcagcattattaaaaatagccccaaagtctaaacaattcaaatgtccatgaaatgatgaatggatacataactgtggtgtatctatatgatgggataaaaatttgtcaataaaatgaagtacttatacatactataatctggtgaaccttgaaaacactctaattgaaaaaaactaatgaaaaaaagaccacatattgtacgattctgtttatatgaaatgtccagtgtaggggctggggaaagtgggggcggggtagtgactgctcatggttatggggtgtcttttggggatggtgagaatgttctaaagttaagacagttgtgatggtcacacaactctgtgagtacacgaaaaccactgaattgtacatattaaaggagcaaatttaatggtgtgtgaattatatctcaataaaaaataatgtggtgtaaatctggccactcatggttttcacctcccttttttttttctcccctattgggacaattcataagttaccatgctgctggcagctctggcagaaaatgatggtgacagaaaatgacatttcaggaatggcttttaaggcacgaggagcaatagcctgaggataatcagagttgttaggctactctcctgtcctggaaagtgaaatcaacctgattctgtccatcatggacactggtgacttgagttgttgacgaatgttctgtaaagtttaatatcccctgctacactttaaatacagagcccaatccaccatatctttcaaactcaggctatttcaaacataactgaagtagaacttcaaattagagaaacttgaggccttctgatcactggccagaggggaaaaattgttttttatgacctgaaaatgtatttagtatgaaaagaaaatgacttcttaagatgagaataagaaaggggggaaataaccaaatttgaagttctaggtaaatacaataaggcaactgaatagacactcctttctcctgttttctattaggattataattggggattctatctccatccaatagtgtttctgtacacttcaaaggtaggctaactatttaaaccagagacagaacactctgtattactctttttatattgatgtcctgttacaaccatgttttgtttcgttttgtactagagaaaaaagaggactcaaacttatgttgtcaaatatttcctagacacttttgtgtgtgacaggaaggaaacttgttaatactgctgtctcaggtaatactgcttttttagttaatactgcccttcatccctgtgtttaccccctcgagcttatcctccctgttatctgattggtttgtcaacattctgaaccaaaactctattttttaatggaaagcctaaggaggcactttttcctgaaagagattggtgtccctgattatacttactcagagccttctctggattactgggaaggaacacacctgtgcatttgatcttaacaagctctaaatctatattgtgttgctcaggggttgcctgacagagctcagtcccatggtggaagaaacctaccaacctcggtcttctcagctttcaaaggcgacacctgcctctggcctctctctgcattctccccattatgatgtggttctccagaccagggaagagaccagggggaaacacaaactaacacaacaagctccttctggttctgtgtgtagctctttgcaatttccctgctctggtaggcagcactttccaatcagccctgcagctccacctctgagaattcttcatgaggaacaagctttctttagtcatagtcacttgtataagaagagatgttttccttcatgagttgtttgaaatgcagtacagtcattccttgtgttctgaaaagctcccactaaatgacatcatttaattccaggatgctcagaatacttaataatacctttggttttgtctttgcaaaacaagttttgtgtttgtggaagggaacaaatctgaggagtggcaagcggcgaagaccaaaagcttatctgtgtggaattgctgctgtagacaagaacaatataatcctccctgttctgtacctactaaatcttacaaagggttagaaaaatagtatttcatctgtctttgggtttttgataataccaaataacatcaaatggaagcagtctcatggtttcttcattgctaaactaattgttattacatacttgttcctgtgtgatgttaatatatattcctggaaccagaaaggtctacatggtcaaataaatttgaaacttgcattaaataagaataaattgatttttttctccttcagggtttcacagaatctttaataccaatgtgcttttttgaacctcttaatgcagctctggtaggctgactttctgtgtgtgtgtgattattttatttactgccaatctccttaaagttagtttttatttaaaaattatttgtataaacacctgaactatttgactttttaaaaattccattctattgtgttaatagcacttaacatgcgatctacctctgtaaaccatttttaagtgtacattattgttgactgtaaggacaatgtggcacagtagacctctagagcatatttatcttggttgactgaaactttatggctgttgattagtaactccccatttagtaactccccaattagtaactctccctagccctggaaaccacaattgcactctttgattctatgagtttgacaatttcagatgccttacacaagtagcattatgtagtatttgaatttctgcgactaacttacttcacttagcataatgtcctcaaggttcatctgtgttgtcacatattgcagagtttccttctttttaaagactgaatagtattccattgtatgcaactgtgtatgcatacaccacattttctttatccatttgttgatggatatttaggttgtttctatgtcttggctgtagtgaatagtgctgctgtgaatataagagtgctaatacctctttagatcctgatttcaattttggtgggggatacatacccagaagtagattgctggatcatgtggtagacatatgtttgttttttttaagaaacatctatactgcttttcatagcagctataccattttacgttcccaccaacagtgtggagcggtctcaatttctccacattcttgacatttggtgtctttttaaaaaaataatactcatccagacaggtgtgaggtgagctctcatagtgcttttgacttgcatttccctgatgattagtgatgttaagtattttctcatatacctgttgtcatttgcatgtcctctttggagaaatgtctattcaagtccttagcccattaaaaaaaatcatgttactaggtttttttttcttttttactattgagtagtaggaattccttgtataggttggagaataacctcgtatctgatatatggtttgcaaatattttgtcccattcagtaagttgccttttcactcagttgactgtttcttttgttgtgcatgaactttttattttgatgtagtcctacttatttttgtttttgttccctgtgccttttgtgtcatacccatgaaatcatggccaagacgactgtcaagtggtttttcatgtatgttttcttctagcaggtttacagtttcagatctttaaatgtaaaataataatattgaattgatattttgtgtatgccataaggtccagtttcattgctttgtatgtcacgtccagtcttctcaatatcattagttgaagagactatcctttcccattgtgtattcttggcaccgtttgtgatgaccagttgaccatgtatgcatggatttatttctgggctctttattctactccattagcctatatgtctgtttttatgccagtatcatactattttgattactgtggctttgtgatatatattgaaataggacgtgtgaggcctccagcttttttcttctttctcaagattgacttggctaagaattttagcattttgtctatttatgtaaaaaaatgccattggaactttgataggaattgcatttaatctgtagattgctttgagaagtatgaacatttcaataatattagatcttccaatccatgaacatttgatatcttttcatttgtttgtttcttgttttatttctttttactatattttgtagttttcagtctgctttcaacttcttagttgagtttatttctagatattttatttttttggtgctattgtaaatagaatttttttcctaatttcttttttcagatagttcattgttagtgtatagaaatgcaagtaatttttatatattgatttggtatatatcaatatataccaactttactgaattcattttttagttctaacagttttttttttaaatggagtctttagaattttcaaatatataagatcatgtcatctgcaaacaatgtggacaatttcacttcttccctttcaatttgggcaccttttttccttgcctgactgctctggctaggactcccagtattatgttgaatagaagtggcaagagtaggcattcttgccttgactctaatcttagagaaaaagctttcagtttttcatcattgagtatgaggttggctgtgggctaaccacatatcaccttaattataatatgttgaagtaatttctttctgtttctagtttgttgagagtttttatcatcaaaggatgttgaattttgtcaattgatttttcagcatctattgagatgatcatatgatttttatcttttattctgttaatgtggtgctaattggttttcatatgttgagccatccttgaattctacagataaatcccacttggttatggtgtatgatccttttaatgtgcttttagattcagctttctagtattttgttgaagatttctgcatctatgcatatcagggatattggctgcagttttctcttcttttgtactgtctttatctggctttggtatcagcataatgctggtctcataaaataaatttggaagtattcttccctcttcaagtttttggaagagtttgagaaagatcgacattaattcttctttaaatgtttggtagaactcaccagtgaagtaatttggtcctgggattttctttgttaggaggtttttatgatagacagtcttgcctcttgaatgaatatttatatctcaagaagctagtgttctgtgaaagtttgtgaatgaagttttagattcataccctttaacctaatgtaataattaagagaggagactttggacaaaaagtactggattctatttgtgggtctctaccaattaacttcatttacagaattagcatagtaatacttgctacaaatcgagttgtgaaaatttagtgaaatatatgtatactaacaaacaaaaccccaggcacttaggtggccttaaataaatggtagctattattgtgtataaaaaagttagtttagtcaacaccttttccagcaagaagcaagaatttctttcgtttataataataatttaataaaatttcctaaaatgccttctgcatgatgcaagaatgatgaaattatatgcaatgttcagttcgattttagtggttagcacaatttatggtattttattgtttaggaaagggagagtaaagaacatctattgagagtttatttagtactcataccagtcttagggagtaaaaattatctaaccccacttcactgatgagtatgcttcagtaaattgctaaagttcatggaaagcatattctgtggcaatgttagaattcaaacccaggtcccctgactccaaagccaatgctgtctccatactgccataccaccttctttaaaaatgaacaatttggctgggcatggtggctcatgcctgtaatcccagcactttgggaggctgaggtgggcggatcatgaggtcaagaggttgagaccatcctggccaacatgttgaaacctcgtctctactaaaaatacaaaaattagccgggcgtggtggcagttgcctgtaatcccagctactcaggaggctgaggcaggagaatcacttgaacccaggaggtggaggttgcagtgagccgagatcgcaccactgcactccagcctggtgacagagtgagactctgttaaaaaaaaaaagaacaattaattcttgtgtgtacataatagctctctgttaactaaggctattctattcttcacttgtttcaaataaatatctcccctactagatctcaatacagtggtcttaagtcaatttaatcccagtaatgttttatagtcattttctcagaatttctctcatgttcaggtaaggattacataattgaacacaaaattttatcttgtctaagtacttctgacttcacagggaattgtgataaggagtataactcagtggagatgatgtgggatggtaggtggaatgctggccgtggccttagtagtgatcttagtccttcccctgctttaagtccctgtgtgacccagtgagttactctgtatctttaggtcttagttttcttactatttgctctatctacctcatgggagttctgtgaagagtagattaactcacttttccaactctccctatctgtagttgtctcaaagtggagaatgcatactccagggatgagcaggatggttcattcgggtagaggaggatgacatcaaggaacacttataggtgctttaaaatttgttcttttaaaatttacgtttttagcatatgttttataatgtatggacatagcattacatttatgaaaaccataaacacacaaacatatattggagatatgtgctttttttttaattaataggggtaggtgataaaaatgtcgagggcctggtggcctccaggataaagtccaaattctttagtatggcatttatgtcctctggggaccctccagcttcatttcctcccccattgcttctccttctacttaatgaactgaacatactagtatgttttgtagcttcactgtctttgcttatactactctttttgccagagactcctgaaacctctctcagcctcccaccttccacttgaaagactaatttctcaagactcagcaaaggagttatctcctgaataagccctttcctgaacctctcaggtatgccagatcactccttccttgggcttccactgtactgtacacatgccacctataagctgtgtggaagtgtgcttgtttgatttcatttactagtctgtagatctctgtattactctacactgctataaagatactatctgaaactgggcaatttatgaagaaaagaggtttaattgactcaaagttccaaatggctggggaggcctcaggaaatgtacaatcacagtggaaggtgaagcagaagcaaggcacatcttacatggcagcaggagagagagagagagagagtgcaggggaaactggcaattttaaaccatcagatcttgtgagaactccctcacgatcactagagcagcatgggggaaactgcccccatgatccaatcacctcttaccaggttcttcccttgacatgtggggattacaattcgagatgatatttgggtggggacacagagccaaaccatattaagggcaactgccatggcttcttaaatcttttttgttttagaacctaaaatggtccctggtatgtatttcataaatattgattagctatgcaaatagcaaataagctctgagagtactatagcatgttaaaatctccaggcaaatgttaatagttattattattaacctacgttaaattctcataggtttcagtggaatatctttattaaaaatcttaatcaagtgacgtgagcaaaacaatcctaattgacacctgtagacactggttttcaaccccgggagctttcaaaaatatcagtgcccaggctctgctcataggggttttgattcaattggtatgggatatgggtcaggcatctgtggtttttaaaagctccccagatgattttcatgtgcaggcagggctgagaaccattgtttcaaatgtcatggataggaaaagaaaggtgcttgggaaaacctaaggcagagtgctcttcctgaaaatgcaactgcagttgtgaaagcttctgtctttgtaaggttaagatgtgtccttgggggaagacacacacacacaaattgcagttatttattgagaccagactactaagtcacttcgatgaaaacttgagagcttaagactcgccagcatgggctaagaatagatcacattgcagaaaccagaacagtttcttggaaggaatggctgaagacattgacaaaggctgagcagaggatgaaattgggaagtcacccatcaactatgggggttgggcaacgtgaaaatgtgcttaccatttgcaatgaaatggaaaaggccttggtgagaaggcagtggagattaatgataataagtcatgttgagttttaacaagataacatacaggataacaaaaaggcaaaagtttattaagtcagatcctgattttgcaactaacaccttttttcctccctctctttttcaccttgagactgttacagatagctgagtaaggtgccaaattagactcgaactgcatctcagggtgaaaactgtgagtgagcatcagctaatgttatcctaaagtgtatggaattacaagtttctatgaagatgtttttgagaaaccttattaggattagtgcgtatgttgtcaacattggattttctagagaatcagagtgaatatagctggtacataagcattgttaatttgcatcatggatatcaaagccttcttgatagaaattacctatttgcactgcatactaatttgggcattgctgctctggaattgataaaagtttagcctataaattggctgaagttccttttgtgctaagaaagaatttgctaagcagatgcataatgtgccattggccattgcggttaatttttttaagagaataaatatttccaagcacttaagtgccatgtgttacaaatcacaccactcagggactagttgaggcttcttttttccttgaagtcgggcaggcaggacctctagtggcaatggctagttagcagttagatttagtgctaatgttttagaaagtacaaactgcacttcttttaaattctggttgatagacttcaggttgatattccccccaataatttaagctttgcacattctaattccctggtgttcaaattgtcacaagttcttgctgtgtacatatttcttggaggaacacttttaaagaaaatggcttcaaagattcccaggcaaagtggacacctggacctgtaaaaggaacgctgcccctaagatgtggaaagaggccaacaaatgttttaattggttcttgacttcagtactactgactttttctcacatggcacactgatgcccctaaatacccatttgtcctctgaatttggtctttcaaacaagggtgagagatgattttgagagtgagaagagagctgttctactggggaaaagggcacagggagggagttttgacaggtatttgtggtggccacagccagtgataaagcaaacactgcagctgagttcaggccccactgtgaacgggcctgcagttacatctcactcctctcttctgtcagttgggtcccatggggtccactggcaggacccactccaggcaggtgtccctgagcctctcctaaccacctctttctcctccatgtctttgctctctatgtggcgggggcaagaggggagcaaagggcagtagtggcttgtgtgcaggcagccagatgggagcctgaccttgggtcacaggcacacgaaaggcacagcctactgatgcactatttggcctgtgctgtgaggaggggggtgcagagggagagaggaagagagaagaaaactcctttcttctatctctaacctaggcatctagtgcatttcagtcctgaattctttcagggctcagctgaaactgttacttcagaacccttccctgatcaaggtcaggccttccacgggctttttgtagcttcctgtgcttgtctctaccagcacttattattattaccatgaattacttgtgtaaatatttattatctgtgtcagtggatgataagcttcatgagagcagagattggtgtctgtactatttatttttgtattcttatgcaggaggcctgagacaaagtgctaaataaatatttgttgaatgagtgagtgaggcaacaaatgaatcaatgagatacacaagaacatatgtataagaatgttctttggaaataacctagagtctagcaagagggaaacaaatcatggagatccatttgtttgaatatgtcattgaaaggcatatctcaaaaaatatttactaacattgaaaaattctcagaatgtaaggttaagagaaaaaagtagggacacaaaaattgacatatggtatgattcctttttctttttttgacataaagaaaatacagagaattcttactattcatggtagttatattctataaggtcactacaaacactgaattgcaaatactgaatgattgcacctaggggaaatacagagttaggctcctgcaagcctctggtcacaatatttttgtcaactgatcaatttataaccttgttttatatgtgtttctgtttaaagacaccttcttttaatatatattattgattacttaacattgaaatcatgaccaacagcactgtcacttatgcctgaaagaagcttatctaataacacacgtattttctcaagacacatcacagtcttgctatgctttggacaccagacagtgcttcagctccatgctgcaggcgattttaaaccacaagaccactaacaaaaagcatataaatatgaaaaatatagcactaagtagatcttagaaaagatacttgtttacagtatgagagctgaaacaagaaggagaggcatcaccttgtttgacttcgcctgggcatgtatgcatcagccaactcaacctttttgctgctctgagcatgtgcatgcccacaaataactgaaatgcactgtgagtattgatttgcggttacaattcaattttagcaagtaggggaatttgcaaatacaaaatctgtgactaatgaagattgactgtatgtccttaaaacaaaaaaaatctcagggcaaatctgcccctcgtggtagcgggactatggtgacataaacatttaaagatgtatccttttctttaattcctcaaatttctaaaattaacttgtattattgtataagtaggaaaataaatattatttttcttttattaggaaatggcaaaatgtgatgggcagaatatatatagagaaagggtagcaaaaatttctttggccagctgtggcacagtaagtttaaacgtaaacagccaaaactgtcagtagagtagtttcaaaaacatattgagccataactttgaaatatattttgagccgggcacagtggctcacgcctgtaatcccagaactttgggaggctgaggcgggtagattgcaaggtcaagagtttgagactagcctggccaacatggtgaaacctcacctctatcaaaaatacaaaaattagccgggcatggtggtatgtgcctgtaatcccagctactcggaaggctgagacaggagaatcacttgaacccaggaggcagaggttgcagtgagctgagatcgcgccactgtactccagcctgggtgacagagtgagaccctgtcttggtgggaggtgggggagcggggggagggggaagaaaaaaagaaagatattttgaattctctcttatatgacttttgtgaatggccaaagtatcattctgtagtcaggaacaggctgactttttgagccagggcttcaagctgaacaggagaaagagacataagcatgaacaagacctatctctgcaagcagaggtcagccacttgacaaaggcagtgcaaaggggatggctttctccggaaatccctcgcttcagctactcatcctccacctcctgccaagtctaggttaggttcccctcagcagaatgtccttctctgttctagcactccccacactgtgttgtcattacctgtatatgtctgtgttcccaactagactttaagctctatgagggcaagggctgaatgtagcttgctcactattgaattacattgcctgacacattgctttgcacgcagtgagggtgaagtaaatatttgttcaatatataacggaatgattatgcatcaaacaccccaactgatagcgactcctgtgagaatcgtcctctttaaatataagtcggtgtcagaaacaacgccaaacctcaaaaaagaatattgaagagttcaaatgagaaaattcaaacaccccaacagacagtgcctcctgtcagaatcgtcctctttaaatacgaagctcagtgtcggaaacaacaccaaatacaagaatagtgaggagttcaaatgagaaaatttcagtcttaaaaaatagacaagatttcatatactcaggcaaaaagagatagaaataagaatctgcctacgtgtgaaaggcaaatacaattcctgtttcctttatcttcttacgattgtacaccctgttcaaccatctttgggcttgtgattactgggtagtacactgctatttcttgaagtgtccataaacacagatagcagagctcaattcctgaaatgtgctcctgtttgataaggtggattggactggatcttgttcagcctttaatctacttccttaagcatctgaggatgttccaaactcaaggctatttcagtacctttgtatttgcaatgtatgatgctttaaaatgataactgtattaactttctatggcctttataacaaattgctgcaaacctaatggcttaaaacattgtaaatttattatcttatagttctatttatcagatatttgcccagatcttactggacaaagattaaggtgttggcagggtacattctcttctggaggctctaggagagagtccatttccttgcatgtttcatctgtagaaggggggctgctttcattgtcttgtgcccaccttcctccatcttcaagaccatcaggctgagttcttcccatgctaccatctctctggttccctcttttcattcccccttccactttcaaagacctttgtgtgattaagcccagcaaaataatccagaataaaaaatcttattttaaggccaaccgtttggcaaccttaattccatctgcaactttaacccacctttgccgtctaccctaatatattcacaaattctggggagtgggatgtagacatctttgggagttgatatagtttggatgtttgactactccaaatctcatgttgaaatgtaatctccagcgttgcaggtaggacctcctgggaggtgttgggttattggggtggatccctcgtgaatggcttagcgccatccccttggtgatgaatgagttctcagtctattagttcacacaaatgggggttgtttaaaagagcctgggctgggcacggtggctcatgcctgtaattccagcactctgggaggccgaggcggttggaacaactgaggtcaggaatttgagaccagcctggccaacatggtgaaactccatctctactacaaatacaaaaactagctgggtgtgggggcacgtgcctgtaatcccagctactggggaggctgaggcaggagaatcgcttgaacccgggaggcagaggttgcagtgagctgagatcacaccattgcactccagcctgggtgacaagagcgaaactccacctcacaaaaaaaaaaaaaaaaaaagcctagcatctctcttgccacatgacacgctggctccttttcaccttctgccatgattgaaagcttcctgaggccctcaccagaagcagatgctggcgccatgcttcctgtatagctttagaaccataagccaaaataaatctcttttcttaataagttactcagcctcaggcattcctttagagcaatgcaaatggaagaacacaggggcaattgctctgcctaccaaaataaatgtacacactattatatatgcatacaaactaggaaatatagtcatttatatttatcaggattcaaaatatcatgtccctatcccaactgtctactgtctgtcccctcactgcccctgaaaaaaagaaaaatatcctaagatgcaaacactcaaaccatggaatgaaatactcttggagataaaaaagtcaaatacttctcttgctatgcggatttaagagaaacatctccacagtatcagttgtgtgggagtttatgtgtaggaatctaactgctcatgagttatctccatgaagtcccgctcacagtatgaatagatgggatcctgttataatctgcttactgtttgccttgcagttgtgcatataaattatgtctaaacccttttcttcttaatcattcttctttcagaaattttgtttatctttctaatttgattagacaaggctctcctatcccccactgcttttttaacagcacagagatagcaggaggattgatcagtgactggagatccacaggggtgataagcttttctgtatatttatgtagaaggcaaaacacagcagaatgagaaatatcagattccagatttcatgtcccatatgtccccatccaaccctgtatcatgcattaaacaaataaaaagtaacagaagggcccagcatgttggcttctgcctataatcccagtactttgggagatcgagatgggcagatcacttgagctcaggagttcgagaccagcctcggcaacatggtgaaaccccatctctacaaaaatacaaaaattaggcgggcgtagtggtgtgcacctgttgccccagctacttgggaggctgaggtagaaggattgcctgagcccggaaggtggagtttgcagtgagctgagattgtgtcaatgcacaccagcctgggcagcagagccagaccctgtctcaacaaacaaacaaaaaaaaaaaaaaaaaaaaaaaaaaaaagggagagagagagaggaaataagtaacagaactagcagcatttcatattccagctaccttttccccatttacaaactcctgagtctgaaacatttgttatatttggttttgagtgaaaccagaatcaataacaaatttgttttgcattcattcctcaatatatttactgcgtgaatatggatcagcagggatggtgtgagactgccacactcaagctgggcgtttgtgcaatccacatcaacacttccaatactctcaagcaaggccaataaatcataaagctcatgtgctactgaattcagcacttcaccatcggcaaaatcaatggagatgcttccagaattttcagttttacagcttcttgaacaaatcttttcccctagtccctctctttgtctgtctggctaaggttgaggcatggacactgggtttgcctcctctccatccaccttctccatccccttttgagaaatgaccacgtggttgaggtcgatcttgtagtcaagccaattgtggtttttccatccctattcccagtgaggcaacttgttgcatgtcattcccctggcaaccaagactggttcagtttgggttgattcgatgctagcagaagttttttggggcttctaggtaaagcgtcctcatccttaagtgaaagtctcaaagagtcatctttccccatcccaaactgattctagaacttctgcaggcatcttattatagatctgatgaagtaactgtcctagaagaatcacagggaggtggagctccttccctatccctgcactcacctctccagttatgcaggaatatatgcattattcttttgtttgtttaatcctgtttgagttggagttttttgttatatttcctcattcattcaacaaataattacaactgtctgctgtgtacaggcactgctttaagcaatgtggattaaaagaacaaaaagggttcctgccttccagtaggaagagtttaaaaagcaaataataaatctaataaatcaggaaactcaacaagaacaagataaagaactagagagtgacaggagctattgggggaaagatgagagcagctgactaattttaaatagggtggtcaggtttcacctcattgaaaaatgtgatttggctcacacttggaatcccagcactttgggaggctgaggcaggaggattgcttgagcctaggagttcaagaccagcctgggaaacatagcgataccttatctctactgaaaaaagcaaaaaagaaagtacaggcatggtggcacacacctgtagtcctagctactcaggaggctgaggcaggaggaccacttgagcccaggagttcgagacggcagtgagctatgattgagccactgcactccagcctgggtgacaaagcaagatcttttctcaaaaaaaaaaaaaaaaaaaaaaaaaaaagtgtgttttgagtagacttttgagtgaatgagcatttgtggatatttggagaagagttttctaggcagaggatactgccaacacaaattccctaagttggaagcttgcttgggaatgtgagaggagaaaggagtggtgggagtgaagtgagggagggcaggggttaacagggagccctgtgggtcttttagcccagtgcagaagcattttgtttggctttgactctgattcaaatggggaaccacagaaggcttttgagtagagtgaaaaagatcactctagctactgtgttgggaaaggattttggagcagtaaaggaaggtgcagggagctgacttagaaggccacagtcccatgccaggctggagatgctgcagcagtggtccagggttgtagtgatgaaggtggtgagcagtggtttggattctggatatgttctgaaggcagagccaacaggatttcctgagtataggggaatgtgggagaaaagcaaggagtcaaggatgactccagctgaaagcaacctaaatcattaactctcaaatttacctgacttgattatcagctatttacaactcatgaatgttacataccatggagaagtccaacccaaacacagggttcacacgcaaaccagtaatttgatattgagggctctacatgttccattaatcacatccccctacttaaaatattttccttggctgccttttaagaataaagttattttccatagtctttgagagttaactcaggtaggaccgaagtgatgaccgttctgtcctctgcagcaacgccattgccctttatccttgttgtgatgtggttttcctgtgtcttctgctgctagatgtgatgacgatatccctcctttgttgatggactcagcatctgtacatgggatattttgactccaattttcctgatgcatcatcctaattgtctggtagttactgactgtcacttaccaaccggtgtgagatattcttcagctcttcatcaggaacagaattacagcctctatctttagaaatgatatatgctgaggattattcatgtttgtaattacaaatctagcagaagtgcaattattaaaaaaaaaacccttggaaaggacattttgttgtataacgcagaacctgctgttagcctcttgtgctggtattacttttgttgctgtaattgccacctgcatttcagttgtaatttaacattatctgtcttctctgtatctttctacctgattgtaattgttaggactcctgccatttattcttaaatactttcttgtctttctgaattactgggctattttctatgattataacctaagaaacagctgcagcaacccttgttgcattgtaaaaacttcagagggctggtttatctctagtttaaaaccagtgaagcaaacagtggggggaccttcggaggtcattcacataaaaccatcattttaagaatgaagaaactgaagcttttgagtgattaactaagttgctcatgatcatttacattcttattgttatgctgtactctggagtagcaagtatggatatatattcagagataggatcttttaagtcctagcactttgcaatttatgctgattaaccaacgacctgccaaacagagctcaagatgggaagggaagcgacactaaatcctttttttgagccagatactgctaggtgctttgtatcatggaccacattgatatgcacaataatctgatgaggtaggaataattatgccaatttctctctctctctctctctctctgtctctcacacacccacacccccccccacacacacacatgctgggatttttgggagattaagcaacaggctcaagagcacacgggtagtaactctcaaatagtaagaactgcttgactttccaccctttctctttctaccaaatcaggaacagaataatggatatcttccaaaggggtgagatatgagcatgagctactttttttttttttttttttttttgagatggagtcttgctctgtcgcccaggctggagtgcagtggcgtgatctcggctcactgcaacctccctctcctgggttcaagggattctcctgcctcagcctcccaagtagctgggactacaggcacgtgccaacacacccagctaattttttgtatttttagtagagtcagggtttcactgtgttagccaggacggtctcgatctcctgacctcgtgatctgcccgccttggcctcccaaagtgctgggattacaggcacgagccaccgcacacggccaggtatgagctacttttaaggcagttggaagcccaaagagcttgggaaaccatgaagactaggcctcacaactgcagttttctcaggcctatgcagctgcctccatccttttgctctgagcaaaactggacctagttaagcaatgttgcccaactgttaaaaaaggaagctcaaaactaggaggtaggatgccagataatttgtttaaatttttgatctttaaaatcttgactctttgagcttgttttgagcctcattggtccaaagtggctcaatctgactgaggaaggggttggaggaggaaggaatgtaaaaatgaaagatcggtgggaaaaggatactgccttaggttgtctgtaggtaaataaaggtttgactctataaaaactctcttcctgaaataatcaagaatgcttcacatcagaagcatcaattaaatggctgccttctttttgttaattctttagtctttagctatttctgctgttgctgcagaggcagagagatggtgaaagaatcaacctcaggaaatagtatggaggtcaagggtcagctaagaggatctactgattttctgatctgcggagctttctgagtgagtctcccttgaattgcaggagggcatccaataggaaacccagtatgcaacaatctcaagagatagcctctagaacactgggattagcattaatccatgaaaatgaggtgctataatgatgatgatgatgagactagaacctatagttacatgcattgtgggaaaggtttgaattgaaaggctgaaggagggagtggttgtcttccaagagggtatgatggtcatgctgaatgaagaatgaagtgaaagaagtcagtgaagatgcattaagaccgtaggtcaggttcaagtagtaactcccaagggttcaaccacataatgacgcattgaaggatgtctattacaatcataagaaacagcaaagtggttgagtatagtggctcatgcctgtaatcccagcactttgggaggccaaggtgggcagatcacttgaggtcaggagttcgagaccagcctggccaacatggtgaaaccccatctctaccaaaaatacaaaaactagcagggcatggtggtgcccgcctgtaatcccagctacttaggaggctgaggcaggagaataacttgaacctgggaggcggatgttgcagtgagttgagattgtgtcactgcactccagcctgggtaacagagtgagactctgtctcaaagaaaagaaagaagaaaagaaacagcagagtgtcccatctgtcctgcgagtcctaaggaaactgattaatggcttcaaaagtttatttctcatcaaaatgaacttgattaattacaaatccagattttttagtcctgccccccaaaagtctgattttaccaatgaaaataacccccaggtaattcctgcaagcagcctcactggaaacatctggggtaggtgaccccaacttctgtcattgtgagtttctgtgtgctacctttcttttttggtttttgtttttaataaacagggtgttgctctcttgcccaagctacggtgcagtggtgcaattatagctcacttcagccttaaactcctgggttcaaggaatcctcctgcattgctgggattacagatgtgagccactgtgtcaggctctctgtgtgttccttctaatagtacttctagaacatctcttatttttttcttttccagctcggagattcttaatttgagtttctggggctcaatgaatagggcccaggggatctacaacccccctgaaattacatgcagaatttcacatatatatgagctatgtgaagagtctcaaaggaatctgtggtttccaaagggtttagaacaattgctccaactgttctatttatctcctttctgccctgacccctggagctggttcacagctttttatcctggccagtcttcctggctttagtggacagtacatttgtctttgactttgaaactttacattaactatgagacatagcgtgaaactttggaaagagaggggatcacttctatgtttctattaaaattaatttcctttggaagaatatgcctgtgacagttttcatagaacactgctgtccccattttaatgagaaacaaaaaaattcatccacgtcaccaatattctattgtgtctcttttctcccagaagccgatctctttgctaaaccatcttcagcacagctccagttgaagtcctttgcttgtctgggtcctttgttgccctcccggtgttctgctgtccacagaatatagccctgactcggtagcctggcatctgtgccctttgcaatctgactacctcctgctgctctcctaattgttccatgttccaagctaactgtgctcctcgccattgcccaagccctgtctgtgccctcttccctctgggcctacaggggatgccctccctctcctctccatctgtcaccgtgtacccttgttcaaggccttcatcccatctctccgtcagccagaaatttcctcttctgtgaacatcaattgtacttggttcatacgggtcttatggcatttgttacatattgatttttgtttgattatgcatgatttgtgtttctcttttttcttattagattccaagacctttcatcacagggcctttgttgatttaactgtgtatctggtcaattgcctgtcacagtacctagcatacaaaaagccctcaataaaatctggtgaatgtatttaaaaacctagatagggctattttaattcagaaaaataaatctgtttgccttttttcctggtaatctaagttgggcagttgcacgagaactgcatataaactgcattcaactcttgataaattagaaaagtcatctgatggcttcattaaaatgtgggctttaaaattatttatgatttcatttttcataacatctttgtgagacttgtagtagtgtagtattccccccgtcttttggatggtgatttcactgaggtgagaggttaaagtgggtcattcaaggccacagagcaggcaggtaacaaaactggcactggaaccttggcctcctggggccacgttagcagagcgtagcattgactgcactaaggatggaatacaaatgtgcttacacattgtcaaatcctgtgggtcaaaaagtttgttttagtgaaagcatcacagataatgaagtatttgaaattttctcttttcaccttttggcatgcaggctcctctctctctgttccctaaataaggacacgtctgtaggtctgatcctcagccctgtctgtctgtgaccttctccagtatccaggaccctcggcgatcaatacctgcctcgtggtttcaatgatcatcactctgctgacttacctaacgtctttgcctatggtgatgacccctgcctgctctccacctcacatctcttgtggtttaccagaagtttccacttagaattctgccatcacttcaaaatccagatatctaaatccaaactcatcatctgctctctgaacaaacttactcctttctcaatctacatttttctaccataattctcctagtcatccaagttcaaaatcattgttatctttaacttcctttatttttttaagagacagcttctcatcccactgcccatgctggagtgaagtggtgcgatcatggctcactatagtttcaaactccggggctcaagtgatcctcctgcctcagcctcccaagtagctaggactacaagcacacatctctgcactcagctattttttttttttttgagacagaatctcactctgttgcccaggctggagtgcagtgctgtgatcttggctcactgcaacctctgcctcctgagttcaaacgattctcctgcctcagcctcctgagtagctgggattagaggtacctgctaccacacacaactaatttttgtatttgtagtagagatggggtttcaccatgttggccaggctggtcttgaactcctgatctcaagtgatccacccaccttggcctcccaaagtgctgggactacaggtgtgagccactgcgctaggcctaatttttaaatttttgtagaaatggggtcttatgttgaccaggctggtcttgaactcctagcttcaagtgatcctcctgtcttggcctcccaaaatgctgaaattacagaaatgagccactatgcctggcctgttattttcagctttttaattggctttgtcttattgatacttccttcaaaatgtttatcatgtccatttgagaatctagagtggtttttttttttttttttttttttttttttgccaaggattacctctttctctagagccctccacctcatgcacattcctttctttctattttcattaccacattgtgatctaggtcttctcttcctcttccttaaatttcactggtgttcattttgttacaggatgaaatccatagtcttcaacctggcatacaaaacctcccacaagctgactccagttgatctttccaactttctagtctaatacttgcctctggtaattttttttccaattcttctgttgactgtcctggaatgcatcttacatggccttgctttggtcctcagtttagttcttttattttccagtttactcctttggatacttctcatcttcaaggtccagctcatgtctcatctttttgatatgaccattcctaattatttaaatccatattctgaagttcttggcccttgttgtctacatctttgctgctcaaagtgtcattaaatgagcagcagcattgtcaccacctggaagatggttagaaatgaatcttggggctctgcctcagacctgctgaattcaaatctgcattttagcatgatccttgaagtgatgcatgaaacacttgtctgtcccatttagatacttagataatactcaatccaaacaccaacttatgtacttatctgcactcctcaagatccttgaaatctgcgaacctgttttatttttctttagtatctctgaaacacaatttcatggtaaagtaggtgcttactaaatagattttagtgtccttctctttctttttctatttaaaggaggaaaaaactcccaagactcctagaaagtgagcatgagctgctatagtttgaatgtaacctcttcaaaattcaggtattgccaatgagatactgttaagaagtgaagcctttaggatgcgattgagccattagggctcctcccttgcaaatggaacaaggtcagcaaaccaataggagtgctaaggtaaatgactgtagaacaaaatggtgtttatgtagcttgatggtacatgtaatttcacaattgcattttgtgtctgaaaaacatatgaggttttgctaagcttagtagagaaatgcctgctttgtggcaatgttgtccattagttaaccagagagaaatatgagaacagatgatgtcactatattcttccactagcctaggttcttaaaagctctaagactacaagtgttatagatgactccagcatgcactcatactgctacttaactttcttcatggaaatgtgtcttattctgtcaacagactaaaagaggggcaaggacatatattatataattttgtatatactcgataatgctcaggacatagagcttcagttccttccctccctccctccctcctgcccaccctccatttctttattcctgcctttcatcctttaagtgtttgttgagtgattgagatcaaatattgatatattgtatctatagaatagaatattctattctagtgctattatatatgctggggataaatcacgcattaaaatgaatgtccttctctttatggaacttgcattccagtggagcaaaaagataaacaaaatcataagaggaatttatacttagaggacgataagtactgcagaaaaagattagagaagagggcttggaattggggaggtatactttaaaataaaaagccagagaagaccacctttgagaacataatttaagaaaagacttgaaggaggtaaattatgtagctatctgagggaagaccttcccagagagtggaacagcaggtacagggctgaggtgggcatgaacagggaagagtaagaacggtcttttgggtttgaagtagaaggagcttgcaggagaatgacaggagagatgaggtcagatattacatctcaataggatctctctggctgcaatattgagaaaagccagaagggggacaaggtggaggtgggaagacgaattagaaggccactgcaataatacagacaggagatggtggtggcttagaccagggaggcagccgtggaagaggtgagaggcagttacattctgcatatattccgagagtacagccaacaggatttgctgaaagattgaatttggcatatgagagacagagaggcatccaggatccaggcatttaagatttttggcctaagcaactagaaagatgcagctgccatcaagtgagatgggggaaggctgcggtggagaagtcttttttagggaagattaggaacttagctttggcaatgttgagtttgacatatcttttagacaagtggagatattgaggaggcagttgaatattggtggaatgaacgaataaccaggatcttaatcaagtgtttaactcccttaaacataaatcaactttttgtctacttcctcataatgtgaagcactttgggatgtgacattggaaatcagactcttctgaccaaggcccaggtctgcctgaattccaggcctagagatctgacaatgtgctggccatcttcccttaaatgttctctagagccacaccatgtctaaaatggaacgcactctctttatcccaagcctggtctccctctttgtgactgtggtgagtgggcaccactaggcatgtaagctggcagtcacacttcattccttccatttcctcatctccatatctaattggtcaccaaatcttaccaaccccacttccaaaccatctctagaacccatctcccccctccgtcttcactgctgcttttttggatttatgctctcattgtctctcacctggattatatgtaaatcttctcctacctggtttcccagtctccaatcgatccttcacatagctcccagagtgattttctaaaatgtaaatgtggccatgttactcttctgcttaaaacatttccaaaggctttcttctgtccataaaacccaaaacttgagtttggcctgcaaggatcatcaagatctggctcctgcttatctcttagatttattatcccccccatcccccccgtcactcctatccattggccagattatactacctgtagttagttaacttattcattcaattttcagatataaataggatgcttcatatgttacaagcactatgctaagctgtgggggatacaaagctagacattgaaaaagcctgaaataaacctggttgtcttccttcctacttacttacagtcgtcatacagtaagctgtggggatacaatgctgcattgtacgcagacttggttcctgccctcatgaaagtatactttctcaatttccatgcctttgctctctgaaccccctgccttgaatttaccaccatctgctcctccctccatctcactgccatgtcctccttctcctaccagctacttaaagaataccatctcaacttttaagaatcagcttacatcattcccttgtattaagctctttactctatctccttttctcttctaaaaatgtttcctccctcaaaaggtatcattgaaaaacttaatagctctagaagtgaggatatctctaaatacattccaggttcagttcagaatattgttttatcttatactagaagatcatagctcaaggaatgggatttccttctttatcccaaaagggaaaaaagcctccttttcctggatttttcccatgctccttgggctccacaagtgggataagcaattgttaacttgctgcagagtgagtgaacccaattgcattggattcacacacagtggatgctccaggattttttttaaatatttatttatttatttatttatttatttatttatttatttatttatttattttgagacggagtctctctctgttgcccaggctggagtgcagtggcgtgatctcggttcactgcaagctccgcctcctgggttcacgccatgctcctgccttagccttctgagtagctgggactacaggtgcccaccaccacatccagttaatttttgtatttttagtagagacgggttttcaccatattggccaggatggtctcaaactcctgaccttgtgatccacctgcctgagcctcccaaagtgctgggattacaggcgtgagctgccatgcccggccttcaggatttttaaatagtaaagcgttaggggtggtgagctgattggtaggggtgctaggaaacttgtcttaaagctaagtttgcatagctagcttacaattttcacttagattaatatacatagatttatagtagcttgtgggggactgataaagatgtgggttaaagattccttttaaagccatcccttaatgctaccactgtacagaaagatggcagagtgactgcctttatagacacctgcccacacttcctaatctgccctcagttgcaactcctagagagtaggcacacagcttagggtggaaaatacatgaaaattcagtacttgtaaatagatgggaggtgggtaatgaggatgagcgacagaagaaaaaaccttctatatttgtctgttctcaccacctaaggggttcttcagaaaaccagtgagctttacgctcaggttgagaaatccttgttacagtcactttaattgcaatctctatttcttctctctttttctttctctctctgtgtctctacacctctccctcaccactttctggatatgcacacatatttacattcagatgattttagaaagctccattggggaataactataaattatgaatatgcaacagcactaaaaccaactattatagtcaaaaatcctgaaataaacctcctggttctcttccttcctacttacttacagtcagcacacagcaatatatcttagagtgaggctaaatggatatctgatactcactcgaatgtgataggcagtcaacaacccagttatcactgttgaagcattttaaggactacttccatgtcactctggctatgataaaaaccatagtctccaaattggtacagtaggatgaaccttccatgacgactggtagcatgtgtttgattacacatatgtatacatacatgtacacacaatacacatacctaaacattataaccagattagtatattccttttgcattgtactgaatactttaaaataatgtttcatcagtgattgtcagagttataaaatcatttgaatatattaataagctataaacattttaattttaaaggataaaatatgctgcacaaaagagccagtacagccactgcttatgtgtttaatttatttaaagagatgcctgttctgttattacttcaaatatagttatatctacatgtaagtgattttaatttgctacaacatttagatgtatcaatgagacatttcataaattaaaattgtatcacgtagggagactatcttgattatgaagctttattaggtgatgattataagtgccttgtttaataattataacagcttaatggctcctgtagttatactttataataaaaatttcacatttaataatatggaaagggatggtacacagtgaactgacaaaaaagtattgattctgaacctttaaattggattcctattgatctgatgtatgaatattttattggtgtaaatgttttcagggttgccagtttctattactgcatgttagcaattttactggctatgtataatggacaaattaaatgccaggatatgggcatatccagcaccccacactgattattttgattcacttatcactatacactactagggccttccctttctctgtcccatctctgttctggaaggtgagccacagacttcttctgtacatgcctcagatacatgacaagccagtgatgggtggtctggcttgttatctggtagaggctgggtgggcatgtgtctcttcctgctaaggcccacagccccttagctaagacttacacatttgctccaaggccagtcatttgggcccgagtacctaatggataataacaggggctctgggattaggtagagcaagatggctgaacaaaagcttcaaccaattgtcctccccacaggaacaccaaactgaacaactatgcacacaaaaaagcaccttcataagaaccaaaaatcagcttaggtaccagcttggccacagtggagtagagcaccaagcaggctcttggggtccctgattccaggcctagctcttagatggcatttctggacttgccctgggccagaacggagcccattgcccttctgggagagtcccagtcctgccagcattcatcacaagctgactgaagagctcttgtgccttgagtgaacactggtggtacccaggaagtactcaccatggacctagggtagtggtgatcacagggagagactcctctgtttgtggaaaggggagggaagagtagaagaactttgtgttgaggtatgtgttccagctcagccacaatcgagtaaggcaccaggtatattcctaaggtttctgactgtaggacctggctcctggatggcacctctggacccacccagggtttggggaattcactgccctgaagggaaggacacaagcctggctggctttgccacctgctgattgtagaaccctagggctatgagcaaagataagcaatagccaggcagtggttaccacaggtgttgggtgagacccaatgctgtgctgacttcaggtctgacctagcacagtcccaagggcaatggccacaagggtgcttgtgtgatcccacccacagttctaggcagctcagcacagagagagagagagagagatgccatttgtttgggagaaagtaagggaagagaacaagagcctatgtctggaaatccaaagaattcttccagatcttatccaagaccaccaagtacctctaagagaccgcaagagtcacagtgttactagactcgaggtgccccctaatgcagttatggctacagtgaccaaaaacttagatcacaacactcaagtccctttgaatacctggaaggcccttcccaagaagaatgggtacaaacgagcccagacttagaagactacaataaatatctagctcttcaatgcccagatactgacaaacatccataagcatcaagaccatccaggaaaaataatcttaccaaacaaactaaataaatcaccagggaccaatcccagagagacagagatatgtaacctttcagacagagaattcaaaataactgttttgaggaaatgcaatgaaattcaagataacatagagaaggaattcagaattctatcagatacatttaacaaagagattggaataattaaaaagaatcaagcagaaattctggagttgaaaaatgcaattaacatactgaagaatgcatcagagtctcttagcagaattgatcaagtagaagaaagaattagtgagcttgatgacaggctatttgaaaatacacagtcggaggagacaaaagaaaaaaagaatgaataagaatgaaggatgcctccaagatgtggaaaatatcctcaaaagggcaagtgtaagtgttattggccctaaagaggaagtacaaagagaaataggtgcaggaagtttattcaaaaagataataacagagaacttaacaaacctagagaaaggtgtaaatattcaagtgtaaaaacaccaagcagatttaacccaaataagactacctcaagacgtttaataatcaaactcccaaagatcaaggataaagaaaggttcggaagaaataatataaatagagttccaatatgcctggtagcagacttttcagcggaaaccttacaggccaggagaaactggcatgacatatttaatgtgctgaaggaaaaaaaccttttatcttagaatagtatatccaacaaaaatatcctttaaatatgaaggagaaataataactttcctggacaaacaaaggttgagggatttcatcaacaccagacctgtcctacaaaaaaatgctaaagggagttttcaatctgaaagaaaaggacattaatgagaaataagaaaacatctgaaggtgcaaaaaactcacaggtaatagcacagagaaaatcacagaatattataacactgtaattgtagggtataaactattcatatctcaagtagaaagactaaaagatcaaccaatcaaaaataataactacagccacttctcaagaaatagacagtacaataagatagaaatagaaacaacaaaaagttaaaaagtatgcagtgggggggaatgaagttaaagtgtacagtttttattagttttctctttgcttgtttgttagtctatgcaatcagtattaagttgtcatccatttaaaataatgggttataagatagtattttcaaacctcatggtaacttcaaatcaaaaatcatacaacagagaaaaaatatgcaaaaaataaaaagcaagacattaaaacataccaccagagaaaatcacctttactaaaaggaagaaagaaagaaaagaaagaaggaaggaaggaagagaagaccgcaaaacaaccaggaaacaaatatcaaaatggcaggagtaagtccttacttatcagtaataacattgaatgtaaatgaactaaactctccaatcaaaagacagagagtggctgaatggataaaaaaaaaaaacaagattcaacaatctgttgcctacaagaaacccgcttcacctataaagacacacatagactgaaaataaagggatggaaaaaatatactatgcaaatgtaaactgaaaaagagcaagaatagctatacatatatcagacaaaatagatttcaagacaaaaactataagaagagacaaagaaggtccatatatgatgataaaggggttacttcagcaagaggatataacaattatatatatatataatatataatatatattttcacccagtgctagagcactcaggtatataaagcaaaaattactagagctaaagagaaagatagacctgaatacaataatagctggagacttcaacagtttcagcattgaacaaatgatccagacagaaaatcaacaaagaaatatcagatgtaatctgcaatacagaccaaatgcccttaatagatatttacagaacatttcatccaacagcctcagagtacgcattcttctcggcacatggattattctcaaggatagactgtatgttaggccacaaaacaagtctaaaaaattcaacaaaattgaaattatatcagtatcttctctgaccacaatggaataaaactataataaatcagtatcaagaggaattttggaaaatataaaaacacacggaaattaaatagtatgctcctgaatgaccagtgggtcaatgaagagattaaaaaggaaataaaaaaatttcttgaagcaggtaataatggaaacacaacataccaaaacctacgggatacagcgaagccagtactaaagagaagtttatagctataagtgcctacatcaaaatagaagaaaaatttcaaataaacaatgtaacaatgcatcttaaagaactagagaagcaagagcaaaccaaacccaaaattagtggaagaaaataaataaagatcagagaagaaataaataaaattaaaatggagaaaacaatatgaaagatcaatgaaacaaaaagttgggtttttctttttctttttttcctttctttttttttttctgagacagagtttggctctgtcacccaggctggagtgcagtggcatgatctcagctcactacaacctgaacctcctgggttcaagcaattctcatgtctcagcctcctgggtaactgggattacaggtgtgccaacatgcctggctaatttttgtattttttgtagagatggggtttcaccatgtaggctaggctggtcccaaactcctggtctcaagtgagccacctgctatggcctcccaaagtgctgggattacagggatgagctactgtgcccggccaaaaaaatgattttcttaaaaagataaacaaaatttttgtcagttgacaagacttaaatctaagacttcaagctatgaaactattaaaagcaaacattgggaaaactctccaggcaagtgatttcttgagtaataccttacaagcacaggcaaccaaagcaaaaatggacagatgggatcacatcaagttaaaaagcttctgcatagtaaaagaaacaatcaataaagtgaagagacagcccatttaatgggagaaaatatttgccaacgatccacctgacaaaggattaataaccagaacgtataaggaacccaagaaactctataggaaaaaaatctaggccaggcgtggtggctcatgcctgtaatcctagcactttgggaggccgaagcaggtgaatcacctgaggtcaggagatggagaccagcctgaccaacatggagaaaccctgtctctactaaaaatacaaaattagctgggtatggtggcccatgcctgtaatccagatcttcgggaggctgaggcaagagaattgcttgaacctgggaggtggaggttgcggtgagtcgagatcgtgccattgcactccagcctgggcaacaaaagcaaaactccgcctcaaaaaaaaaaatctaataatcccattaaaaactgggtgaaatgtctgaatagacatttctcaaaagacatacaaatgaccaacaggcatatgaaaaggtgctcaacatcactgatcatcagagaaatgcaaatcaaaactgcaatgagatatcatttcatcccagttaaaaaggcttttattcaaaagacaggcaataacaaatgctggtgaggatgtggagaaaagggaactctcgtacactgttggtgggaatgtaagttggtacaaccactatggagaacagtttggaggttccttaaaaaattaaaatggaactatcatgtaatccagtaatcccactgctaggtatatacccaaaagaaaggaaatcagtatattgaagatatgtcttatctctgtactcccatatttgttgcagcactattcacaatggccaagatttggaagcaacccaaatgttcatcaacagatgaatggataaagaaaatatggtacatatatgcaatggagtgctatccagccataaaaaggaattagctcttgtcattgtcaacaacgtggatggaacacgaggtcattatgttaagtgaaataaaccaggcacaaaaagacaaacttcacatgtcctcacttatttgtgaaagctaaaaattaaaacaattgaacacatgaagatagagagtagaatgatggttaccagaggttgggaagggtattgagggtgcggggaagggacggtgagacagtggggatggtaaatacgtataaaaatatagttagatatttagaattaataagatctagtatttgatagcacaacaggttaactatagtcaacaataatttattgtacatttaaaaataatcatttgtaacacaaagaaaggataaatacttgaggtgatgcatacccatttgcccatgcaataatgcctgtatcatgcctgtatcaaaacatctcatgtaccccataaatatatacacctactacatacctacaaaaataaaaaaaaaacccctggactctggagtcagattcattcaattcaaataatatttattgagagccaaatagcagacattgttccaggtgctaggaacagaatcgtgatcctggcttcatggacttccattctcatgattgcctaggttcaaatcctaactctacctcataacctcaggaaatatgttttactgtctgaacttatctcttaatttgtaccagattcatgtttgttgcaagaatttacagaggcaatgtatataaagcatccaatatcatgcctagctcattgcaagtgtcacttatttttatttttgggtgaaagtctgatgcaagccatatttatgccataaatttaattggatgtgaatatgatctactagttgaaatgactctgatttctatgctttttaatctagtctgagcagcatttatgatacagtaatggccaaaagacaatgaaaacactattatttatcttaataagacaatcctaagccaaaagaacaaagctggaggcatcacgctacctgacttctaactatactacaaggctacagtaaccaaaacagcatggtgctggtaccaaaacagagatagagaccaatggaacagaacagagccctcagaaataataccacatatctacaaccatctgatctttgacaaacctgacaaaaacaagaaatggggaaaggattccttatttaataaatggtgctgggaaaactggctagccatatgtagaaagctgaaactggatcccttccttacacctcatacgaaaattaattcaagatggattaaagacttaaatgttagacctaataccataaaaaccctagaagaaaacctaggcaatactattcaggacacaggcatgggcaaggacttcatgtctaaaacaccaaaagcaatggcaacaaaagccaaaattgacaaataggatctaattagactaaagagcttctgcatggcaaaagaaactaccatcagagtgaacaggcaacctacagaatgggagaaaatttttgcaatctactcatctgacaaagggctaatatccagaatctacaaagaactcaaacaaacttacaagaaaaaaacaaacaaccccatcaaaaagtgggcaaaggatctgaacagacaatcctcaaaagaagacatttatgcagcccacagacacatgaaaaaatgctcatcatcactggccatcagagaaatgcaaatcaaaaccataatgagataccatctcacaccagttagaatggcaatcattaaaaaatcaggaaacaacaggtgccggagaggctgtggagaaataggaacacttttacactgttggtgggactgtaaactagttcaaccattgtggaagacagtgtggcgattcctcaaggatctagaactagaaataccatttgacccagccatcacattactgggtatatacccaaaggattataaatcatgctgctataaagacacatgcacacatatgtgtattgtggcactattcacaatagcaaagacttggaaccaaccaaaatgtccaacaatgatagattggattaagaaaatgtggcacttatacaccatggaatactatgcagccatgagttcatgtcctttgtagggacatagatgaagctggaaaccatcattctcagcaaactatcgcaaggataaaaaaccaaacaccgcatgttctcactcacaggtgggaattgaacaatgaaaacacttggacacaggaaggggaacatcacacaccggggcctgtcgtggggtggggggaggggggagggataacagtaggagatatacctaatgtaaatgacgagtaaatgggtgtagcacaccaacatggcacatgtatacatatgtaacaaacctgcacgttgtgcacatgtaccctagaacttaaagtataagaataaaaaaaaatgtagtcaattgtggtgagtcataggagggatgccaagtgtggaatcaccacagatgccagtcaaggctcaacgtgaccagctgttcagggtgctttgacaatcccaagccttgaaactacctaaaggctccttctgagtcaaatatcaaaaaaatggatcccaaatgactcctaatatgatttctcccagatgctctttctgataactttgtttccgacgttgatatctgatgctctcctaattactttggaccactttcttcctggaagactctatatggctcttatcattgagcagctctttgcaatgaagatgggaaaagacctccactatcttctgttatgatctaaggccctcgatgaggtacccattgcctccatgtatcttcctgggaaggcctttctgaggctttggctggtatcttaatttcttgtggaatatacatactggtgttctggtgctgtgatgtctggatatgttgaggtattgaccataccctggccagtggttttccttttgtttatatggagagagtccctgctctggcaagggaagagatgaagggaagagagggtagaagaggggaggggagggaagaggaggggagaggaggggaggggaggggagggaacaatttactgtgcctttttaaaaagagatcagccaataaaaaggtagattttggagacagacaaatctaaaaaaaaaaaaaaaaaaaagaaatgaaggttccaaattgatcacctaaatcatacagtcctttatcaaaatgcctggaagcctgtctaggctggaggttggctaacagcatacactcagctgacccggggagtactgatttattttcctatgttagaagttaggcctcatctgaaaggcagagagaagggcatcatcacactctatgccctatggactgggattggggtgggcactggagactattcaagagggcatttttgggaaaataggaagagagctcatggtggaagacagggaaagtaccagtagaagccgcattctgacaacattccacaaggagagaagctaattaaaaatgggaacctgacataggccaactaaatgagtatctctggggctgggatctggcagtgatctttcataagaaaaactcccctagataattctaacatagccagaggtaaaaacaacaacaaaaaaccccactactgctccagactagtagttctcaaagtgtaattcgcagaccagcacacgtgggtatttgtagaagtgcaaattaacaggaccccccaccaccccagatctactgaaacagaaactctgagggtgggactcaggaatctgtgtcttaacaagctctccagtgattctgatgcttgctcaagttggagaactactgctctagataagtcataccagaccaaaaaaacaaacaaacaaaaaaattaggaaggtcaggaaggcaggcagggtaaaatggatcagggtggaagtccactgtggtttccttttgtactttagagaagaatgaaaaacgcacattgctcacttccatacaactttggagaggggaaggtatctaacccttcacctttctctctcctaaagctccttcctaggagccattaaatgacagaggcctcttggttccaagtgggttttaggatttttaaataaaatgcagagactaataatgaaatttgttggaccatcagaaaggacagcagatggcccttgtgcctaggagggagggagggagggtaaccgctttccagaccaggaaaaaataaactaagaataaaaagaaaaccaaatgattaaaactgaactttgctttacttttcccttttatttcatgaaagcagtgtttgggcacagtagagatatgttaataaaattgaataatgtctcttgcactaagttttcagtacaagatgaaaactgcataagaacatgttctaatgatgcgttggttttctcacagtaacatccagcccccagaacattctctggcagcacccacactctcctgtcctagtgaataaacctggaacaaagctgaaaatctgaggagctgccgcctggatggggaaggatatgcttgtgaaatgtagcttggctctgttgctgacttagatgggagtacaggaaagtcattagtttctctggccctcaattttctcaagtaggaaatgacagaaaccacccaaatgaactgaaatgtcaaagtgatctccacaggcccaggaagagggccaggtgccatagccaaacaggatagcagaaaatcgcacaggctcatggtgtcacattctggtaaatgggcatgatgaaatttaactaagctgaaaaactgagaagtttagtgatcaaatgtgggccaaacattctatgggcatttttgttgttgcttattttaatggtcttttcctcctcatactcacatgctgtgcaaaaattatataattatataaaaaatatgaattatataagtaaagaaccccaaccaaatctcaactgattttgtgaaaaagaaatatcttttttttgcttactcttaagttctttttatcagaaaacaaataccacatgggattattattttaaacacaagctgcatttaagagaaagtgtctagtaaaccttctggggctgtaaattagctgctaattttgtttgactaaaggctgtaaaatgcatttctgggaattattgtgcacagagaacatcctcctaatacttcagtgggcttgaacagagaaatggaatcctattcagtatacctgttactaaactgaggctactccacgacccaggctcattctatctaactacatagccagcttttctggatttgtgaaagatgagattttgggaaagaacatgagaaacaatgagtcattcacagacacataagtagagatttgaaattggtgttcagaccatctaatcttcacatttcctcctttgttcaatctcattccagtctctgaaattttccaagggcctgtttattactctgttctattcacctactgctatgttcagttactgccccctgtttctctaatggagttttgctttcaagactgggcacaactcttctcaatatgtatttacatttttcatttccttatacaagttccatcattttttctttatgatagttttctttaacctgtttattcatttgtttcatttgttatattttcatgttttttatcctggtccttattttcctccatgacacctcttcttatacttgatgttgttctctagaatgctgttaaatttgctacctgtctctttcaaaatttacctgggcaatggtagcacacaaagggccatgcagacttgccaatattaggctggtttggcctagcatagtacctggcacacagcaggcattcaatcaatatctgttcagtgactgcctgaatgaaaatagaaatgatatcagtagttttttgcaataatcttaagcaaaattataaactaataacttccactcctttaaatgtgtgtcaacttttctgtactaattggaaaaacatctagttcatgtggatcaaaattgagtctatatgctacgtagggcaaaggcatgcctggattttaacatctcatcctcagtgactctaatggtgcctggcacagaggagatgcccaataagtttatatgaaatggcttagaatggactaccttctccatgcgactaatgatctgttactacttcctgaaaggttagccattattgatataccacttctagatgctgtgacaaatggcacagctcagcagcaaaagtactttttaaagtctatgggcctccacaggttgagtttgaaaaggatctgttaatcctctgaaattacatgtgatttatggggagaaagtttacaaaattattaatactcttgaaggggaatatgacctccccccaccccaaatttcagaaccacagtggataatgaaagtttctatgctgtaagagcaattaggaagtcctgaaaaacagggaatttagtcaggagacttgagttgaaatcctaactctgccccttgctggctgggtgaccttggccaagttttaaactctttcttatcttcagtttccttattatgacatggtgatgttaatgacaagtctctagacatagtggttaaacttcaacttgaacccaaatttttctggctctaaagcccaggctcttaacatctatcatcctacattaattaaatgagataactgatgtgaaaatgcctgatgtaaatatttgttaaagcaacaacaaaaaatgtcatttgtcaaagtaacaaagtattttttaaagtaacaacaaaagagacagataaccacaaagaaaaggccactttagaaattcctctttgacctattaaagaatgttcaagttcaaaatatgtttgtcattatgattaaaaatccaaccccaaaacttgggtgaagacggcataatctgttagtttggatatatacagactaaggggattctttggaataccctttgtctagagtgatcttatgacatggtacggataactagactcacctaacattcaaatgaagggctgtgtgtcttctatactttgtagacagaggtggcagatcatctgcttttaaatatagagggctcccattctgctaggatccagagggaatgagggtcctatgttacagatgtccctctgcctgcacaaaaggctgaagaacaagccatcatggagtgtgggagatccagctgttgtccatttccagaagaggagtgaatagtggcttaacagagaggacccttgcctggttctctttggaaatttcacagtagtgaggccaggtgcggtggctcatacctgtaattctggcactctgggaggctgaggcaggtggatcacttgaggtcaggagttcaagactagcctggccaacatggtcaaaccccgtctctactaaaaatacaaaaattagccgggcgtggtggcgtgcacttgtaagcccagctactagggaggctgaggcaagagaattgcttgaacccaggaggcagaggttgcagtgagccaagattgtgccactgcactccagcctgggcaacacagcgagactctgtctcaaactaacaaacaaaaaatttcacagtcgttatgaacagataatatgctcaggtattagccatttcattgcattgttttgacaagtgacaggaattaggtttgctaatgttggaagaaaaatctcacttgttgcttttaacttaaaccttttatggttttgagataggtttattcactgggctggagaatgaaggatttatctgtattagtcggatttgatcagttttcaagtagctactcagtgtcaggcctatacattatctcgtttaactctcttaacaccatggtaaggttgactgtatcataatctccatttatcagataaggaaacaaagattcagagaagtcaccaagttgagatcattgcccagctgcacacagctagtgagtggtgaagctgagacacaaatcagggcttccgacgccactttctattacactttactatgctgtgcattcgtgtaaaagcatgatatttttaaagtggcattccagctgccagaaggatatcaaatcaagtactaaagacaatattattagaaatggaaatctggactcaccaagaaatgtcttcagttctatataataggaagactggtattttgcttgatatgggtgtttcaatatcatctgctcctaaaatgcagtctagacacctcttgtgacctgctcaggtgatactaatgaagtttgggtcatttttagcatctacagagaacagagtaagagtgctgtgtgttcaatactattgcagacttatgggataaactggattttcttgctttactttataaagctaatgcctgattacaaatataagtttaaaacaaacctcaaaatttcttggcacccactctttgtggttggtaacatggacatctgtataaaatacccaagaccttcatagagcaaaagtgagtgggaaattaatttttattgggtatataatcatcactagccatgttcaaatactttttctctaaatcctttacaaagatcttgtaagttgggtattattacattcagtttagactaaacgaaatgcaaaaaaaaaaaataataaagaaaatagactcacaaggtaaagttgcatacttgagacataacaaaattaaatttcattctatgatgctgccacatagcagatgatacaagcagtatagaatacccataaacattatgttttaaggtatttccacctgtatctttcttggggcaggtaaatgaaactcactataaaccagttacaggtcctcctttatctgaggttttgctttctgaagtttcagttacctgcagtcaaccatggtctaaaaatattaaatgaaaaattccagaaataaacagtttattacgttttaaaatggatgtccttctgagttgtgtgatgaaatctcatgccatcctgctccatccctccagggatgtgagtcatccctttgtctagtgtatccatgctgtctgcccttagtcagccttcttggttgtcagattgattggtacaatggacacaaggtattaccgtgcttgtgtctaagtaacctgtgttttactattattacagtctattgttatagtttctattttaatataagttattgttggtaatctcttactgtgcttagctgataaattaaactttattatagatatctatctatatctatcacagatatatctatagatacgtacctgcgatatgtatctatatgcgatatgtatagatacatatcacaggtatgtatctatagatacatcggtatatatatgaaaaaacagtacatatagggtttggtactaaccacagtttcaggcatccactgggtggggatgcgggtcttaaaacacaacccttgtggataagagaggactactatatggaaagtcagagttagagagcttttgtaggttatgtagttcaatcttttgttttgctggtaaggagaagaatacaccttaattttgacttcttaactcgaaaagttaagaaacttgtctaaggtcacagagctagtggcagagcaagccaagcatcagtgtctccaaaatccagctcagtgttgtttgtgttatatcagaatgagtaagagttaagataagaacatgagtcttacagctccactatccatgttcaaattcttgctgaatgattggggaaacttacccaacctctctggacctcaggttattcacaagtaatacgaatataacagtatttgatagagccaattaaatgagttaatatttgcaaaatgctgaaatcagtgcttgccccataatgaatactcaataggtatttagatatttttattcttatctttcctcccaagcccaacctagtgtagaaacttctggaatggttgaattgaaggagaaatagtataaacagtataaaaaggtaaactttttaaaaagagaatcatgaagtagtgcttctacagagattgggggatggcaaacaacccatggagtaaattcacaagacttgacacttaagaatccaagagggctgcatgagatgagtccaggtaggcctcgtagacaaatcttagatggagttaactcaggaagccaaggagtatgagccagtagtcatcctgagcaaggataataatttttctttctgcctgccttcttgccttcttgtctccttgcctaccttccttcctttcttccagctttccctccctcttttccttccttccctatctccatccctcccttcctttcctacctccctcccttctttcttcttccctttcctccttctttccttccttcatttcttccttctttcctttcttcctccctctctcctacccttcttccttgcttccttcctccctccctcccctcccttccttccttttccttccttcctttccttccctccttcttcctccctctctccctccttccctacttccctccctcctactttcttctgtttcctctttccttcctctcttcttctttcctccctctcttccttccctccctcccaccttcctccctttcctcttccttcctctttcttccttctttccttcctccctcccatctccttccttccttccttctttctttccttcattcctccctccctcccttccttttttctctacctccctccctccttccttcttccttttcctccttctttcctttcctttctccttccttccctccctcccttcctgccttccacccttcctaccttcctgccttcctgcctgacttcctttcttccctcccccttccttctttcttgccttcctgccttgcagtcaccgaatgttttttgagtgactatgatgtgccaagacccggtataagggtgcacgaaataaagtctctaccctcaggagcttacttcctagtgggggagacagattataaacaaagacacaaataggtaatatactattatgtggtgaaaaatgctacgaagggaaagtcacagggagcatttttgtttggtttttttttgttgttttatatagaatggtcacaggtgcctctctgaggagcccttggagcagacacctgaatgaagtgaagccacatgcctggagaacaaatattcagactgagataagagtgaacacacacctgcagtgagagagagagagagttgggtgtgatttgcagacctgtaggaaggccagtgtggttgggcagagggagcagggaatgtaggcaggggccagatcacccagtatttgtaaactgaggcatggactgaatgatagggcggcttcattcatccaccaaaccacgtgctgagtaatctaccccaattccaaagcatgaacttgacaactgcttcttcatagtaatagatgaaggataaaaaaatttaaaaagcatatagatgagccaacttttatgtgcttaaagtgaaaacaatcatgtctataagacaaaagaaggaaagacatttgacatgctccatgtacctgagattcatctcgtgttaataaaatgttgaacatattacactattggccggtgtttagtttcagctgaggaactaattcctaaagctgcagcctgggggatggggagatagggtggacactgagacagggcatggaggaattcagatggtatttaccccagaaatatttactgaaattgggaatgctgagtcaagcctagccatgctagagggccttgggaaggcagttactagaatctccttgatttttttccaatttcagaagaagcaacaagaagaaagtgtcttgactaatccttctagtgaaagatattcacttttataataaggtgcttgtctacacagaggtttctgagtcaaaggaggagaacgtacaaaatagaccgaaagaagagcctgcctagctgctctttttcttttgtaattaccaagatcccgacggtttatacccactcaactgcaggtgctgggagaggagaggctactgtgacaaaaattatataaagaagagcccagcagatgcatttccagataaacaatgtaaaacatagtctatgtaagtgccataaaatttcactaataaaaaacacacatggctcagggaaacatttattatcaaaatggaagcaggaaagggcatatgctaagtcttattcatttcaataaatagcagaacgtgaattgataaaagttcttaattgaaaaacagttgctcatttgtagtttgatatttaaaagctttctaaacatgtatttattttgttttgccttgaagtaattagctattagactaactattttcttttcatgtcaggtacacagtggctccaaagtcaaaacaaggttagattggaaggaagcaaacaatgaaattgaagggaaatatcgacacttctcaatcaatgaaaatgcatcagcatgtatgagcatctttagctggcaataatacatcagaaataaataatgttagcaaaagagacagcatcattggctattcatagtatgtattcacggttgtacaataaaattctaaaggctgaggttgaaagtgaataaaaattattagttctaaacacttgaaaattccagcagcttagacatatttttgtatgctttcagtgccccaaatgtaaaacttaaatcattttatgaaaaaaccttgttcaatcttttaagaaatttgcatttcattgcaaagatggaacatagcatccttggctgagttattttctatagaagtcagtgccattttgtggtatatgattagcacattctaaaggcaaagattccagaacgtttaaatttagttgtgaaaaactgaaggcatttatccattcatatataagcatgaaaatgcaagcttcactttctcagtatgtttaaatgccacatattataatgggaattctagaagatgtgatcatcaaactctgatttcacgcttagaaatcaaataaaaaagagactggcctataattagaaaattagtcaagtcagatctaatatcaacacatggttgtcacagaacaaaaaatttttgctttgagaaaaatgagatatcattctggatgaatattctgggtcagtagaaaatagggaatcaaagtatagaaataaagtgtttatgtcactgtaaaacttctagttttctaaaataaaatttaaatatctgaaatagcagtttatacttcatactcatacagtcaatagacattggtagcttaagaaagaacttggtaagtgatgatttaaagagtgatatagattcagtagtattcaatatacagttgtaattgatgagctcatcaaactatggaatttgggatatttacataatatttacattatataatatgggagagatagcaagtatctataaagagtttaaattcccatactaggaaatgtatagtttgttttaatctatgtctacatttaaagtagatttttttttcagagacagcatatagttgggtattgctttttaaatttttaaatctaatctttgtcttttaaattatatttaacgtagttgttgatatggttgaatttatgtctattaccttgctacttgttttctatttatcccatttattcttgtttttttccctcaatgtctgccttcttttggattatttgttttagtattccattttatttccattagtggtttattagttatacctccttttaaatttatttacctaattttagttggtgccacaaggcttaaagtataaatctgtagtttatttttggaggatctttgccccacagattccagtcttaccatgctatttattttttagcgatttgattacgctctggtcaatatgtgattatgtgcaaactgtgtgtgtgtgcgtgtgtgtgtttatcttgcttgaggtttgttgaatttcttggatctgtgggcttagagtactcacataaaacttaaaataaatttctatattcttttttctggtatactgtctatgcactcttaattcatatagtcatgtttttatgtcagatattccattttttgtctttaaataatataccaattaatgtataacgtgatccttacaatagttatacttctatttccccatttttcctgctattgtgataatacattttacttctatatatgacaaaaaaccccatgatatacataacagtgtatataataataacatatttttgctttaaatagctaagtcttttaaataaatttttaaaacgagggccgggcgcggtggctcacacctgtaatcccagcattttgggaggccgagacaggcagatcatgaggtcaggagattgagaacatcctggctaacacggtgaaacccatctctactaaaaatgcaaaaaattagccaggcgtggtggcgggcgcctgtagtcccagctactcgggaggctgaggcaggagaatggcgtgaacccgggaggcggagcttgcagtgagctgagattgcgccactgcactctagcctgggcaacagagcgagactctgtctcaaaaaaaagaaatttttttttaaatgagaaaaagtattttatatttatccataaatttaccacttacatcacttcatttctttgtgtagacctgagtttttatgtggtatcattttctattttttaattaattaatttttttttgagatggagtctcgctctgtcgcccaggctggagtgcagtggcgcaatcttggctcactgcaacccccgcctcccgggttcaagcaattctcctgcctcagcctcccaagaagctgggactacaggtgcatgccaccatgcccagctaattttttttttgtatttttagtagagacggggtttcaccatgttagccaggatggtctcgatctcctgaactcgtgatccacccgcctcggcctcccaaagtgctgggattacaggcgtgagccactgcgcccagctatctttctctggttttcatagtttatggcaagaaacctgcagaatttcttacctttgttactttgtgaagtgtcttttttctctggatgcttttagattttttttttttagcaatttaattatgctgtggttaatatgtgtaattatgtgtaagctgcatatgtgtgtatgtgtgtgcgtgcgcttatcttgcttgaggtttgttgaatttcttggatctgtgggtttgtagtcacaccaaatttacataatttggtagccattatttcttgagatattatcccccatccattttttaatgtgtccttttttcccccaaatatacatgttagactgcttgatattattccacaggtcacttaggctctgctaattttttcactactctttttttctacatacttcattttggatgattctcttactatgtcttcaagttcatgggctttttcttttaatccaaatggtcacattttcatgtcagatattcttaatccaaatagtcacgttttcatgtcagatattctgttttatttttgtctgtagaaatcacatttgggctttaaaaaatatcctcaatttctctcctcatttcatgttttcctttaaatacttgcaaataggtttttttgtttgtttgtttgttttgagacggagtctcgctctgtcccccaggctggagtgcagtggcgcaatctcggctcactgcaagctccgcctcccaggtacccgccattctcctacctcagcctcccgagtagctgggactacaggcacccgccaccacgcccagctaatttttcattttcgtatttttagtagagacggggtttcaccgtgttagccaggatggtctagatctcctgacctcgtgatctgcccgcctcggcctcccgaagtgctgggattacaggtgtgagccaccgcgcccggccgcacataggtattttaacattcttgtatgctagttccattatctctgtcatttctgaatctatttctatttaatgcttttttcctcctcataatatgtcacattttcttgtatcttgtctagtaatttttgatagaatgctgaagattataaatgccaggtcatctggattttgacttccttaaaaaatattaattttggttttggcaggaagccaaacaaaaatccagatctaaagtccaagtttctagatatttgcccctcagcttctagcctgagcctctccaaactccagtctctgtcttctgagtcagccaggaagtaaatccaagctgttttgggttacccttccctctgcttatggaccataaattgcctcctggaagaaacctggggcaattgtagaaatcactttttttgtcttcttcctctcagagatcacagccctaagctgcctacaatctgatgtttgaaaacagctgcaccatatattttgttcagttaaattttttttttttaggccaggcatggtggctcatatctgtaatcccagcactttgggaggctgaggagggaggactgcttgagctcaggagtttgagaccagcctaggcaacatagtgagactctgtctctactaaaaataaaaaaaattagctgggcatggtggcacatgcctgtggtcccagctactcaggagccatctcaccgcagcctcgaattcctggcctcaagcgatcctcccacctcagcctcctaaagtgctgggattacaggcaaacaccactatgcccggctattgttcagtttttttttcttttgttttttgttgtttgcttttgcttttttgaggcagagtctcactctgtcgcccaggctggagtgcaatggcacgatgtcagctcactgcaacatccgcctcctgggttcaagggattctgctgcctcagcctcccgagtagctgcaactacaggcgcataccaccacgcctggctcatttttgtatttttagtggagacggggtttcaccatgttggccaggctggtctcaaactcctgacctcaggtgacccacccgccttggcctcccaaagtgctgggattacaggcgtgagccactgtgcccagcatattgttcagtttttaatgggaggttagggacaaattttgatactccattaacagcccaaagcctatttcccaaatctgttttagatacccttagatgaaataattcttacagaaaccatgagaccttaaatgattaatcataattatcaaagaaaactcctgagcagttaatgtcaaatgtaatatgatgtaagtaagttgattgataatattcgtgtcttgttaaaagaggctactttagtctgctgagatactgaacggattttcctaagggaaggagtatctgatatgaaataccagttaatcatcagtcaccaaccattaattaaatggctactttataaaggacattaaactgagcgctagatggagtatgttgttgcagtcatttcatagaaaagtctacaggggtaattataagaaaaagaaattgggtatttcaaagatctagtcactgatataagtggaatgtgatatcaaatgtgaatcaatactttaaaataatttttattaaatgcttattagatacagaagaatgctataaaaatatatgtaaacttaaaagtagtgcttctgaaactttaatgtgcaaacaaatcacctgagatcttgttaagatgcagattctgattcaggagtctggggtggggcctacctctgtagttctaaaaaaaaaaaatccaggtgaggacaatgtttctgctctgcagactatctttggagtagcaagagtaagagaagtgaaactacaatgatcatctgtgtgcccaccactggtgtaagaaaaataactttatttttatctctaatgtcttctgggtaccccctcctgatcccttccctccctcttagaaatgactacttccctccctcttagaaatgactactctcttgaattttgtttttatcatccttttgcttttcttaaaagttttaacacatttgcttgtcacttcaatatatattgttagggtttgcatatttttgaatgcatgaacctaatataaatggaatcatttgcatatatccttcttcaatttttcataccacattatgttcctgaggttaattcatatcattgtaatcatagtttgtataaacttaatttattttcatcactgtatggaattctattgtatgaatatacataattcattttaccgttgttgaattttgaaatttaggttttatactgccatgaaaattcttgcataagttcctggtgcacacatgcaacacttagtcagattatatacataggtgatgaattgctggctcataaggtatacacattttaaactttagtagattatgccaaattgttttctagagtggttatattgacttgttctgccaccaactgtgtgtacaaatgttctggttgttcctcatctgtattagttttatattgctgcacagcaaattgtcacaaatttactggcttaaaacaatatccacatattagatcatagctctataggtcagaaatccaggtgggcctggatgggttctctacttggggtctcaccagtctaaaatcaaagtttcagctgggctgactcttatctagaggcgctgtggaaaaatctgcttccaggctttttcaggctgttggaaacattcagttattggcagttacagactgaagccccttttcctgctgtctgttagctgctaaggaccactctcagctcctggaggccactctcagatccttgtcccatagccccctccacttatcaatggagaccctcctttgcatcaaattcctctcatgcttaaaatctctctgagttggataaaagtcaatatataaagagctaatgtgattagattaagcatatccaggcaatctcccttttgtcatataatgcaccatagtcacaagaataattccagcgattaaagttatgagggtcatctatagaattctgcctactctagtttactgatagccagactggccccatgattcactactgtttcataggtaaaatatattcaccacttcccaaggttcctagtgctttgattccattacagcatcagttcaaagtctaaaatctcaataaatcatctgaataatctaaaccagatggaatataaaaaggagtcagcaatccaaagcagtgttgaaatccagtggagcaaaactggttgggaaaactccactgagtttcaaggcctgggaataattctctttagctctcagctcctccctctccacttttggtttcaccctctgagtcaactttcttttttcataaagagtagatgaatagttttatctccctgcttctcgcagtagaatttgagcagatgtaagagtctcttttcattttatactctctctgtcccttttggtccagctggtagtatttctgctgatacaattttctcaagaactttctggatctcctgtggatatcacagtgattcactgcatcatacagaacacatgctgacaagtcttttgagataatcccttctctatttttggcttctactgaaatggttgagggacagaacccttaagcccagaggtcctctggtttaactgagaagatctgtgagaaacacccttaatctcctggaagggtagtttgtgtggtaaaatactctggccttttgatatttctgagttttcaacaaagaactgtatagtatacactcagacttttctttatgccactgttttagcagccatttatgacttttagcatccttttgccatctggagaggctgtgaattttctaaattatctactctggtttctgtttaaaagttcttccctcaatttatctctctcctttcacaatttactataagcaacaaggagaaatcaggctgtagctttaacacctttcttggaaatctccttagctatatattaaagttcattgtttacaaattctgctttccacataactgcaagatgcaactttgctagctatttggccactacataacaagactctcccttcctgcatttctaataatatgtttctcacttctttcttagtccgcactgacagcattctcaaagcccagatttttttaacctatttccttatattttaatgggttttctgtggctcatggtggctcatgcctgtaataccagcactttaggaggctgagtcaggaggactgcttgaacccaggagtttaagaccagcctgggcaacatagtgagaccccaacactgcaaaaaattaaaaaaattagctgggcatggtggtgtgtgcctatagtctcagctacctgggaggctgaggtagaaggattgcttgagcttgggaggtcaaggctgcagtgaactatgattgtgccactgtacttcaacctgggtgacaaagtgagactgtctcaatcaatcaatgaatagataaacaaaaaatgaatggaagttcttgtagacaaatatatgtggtttggcttttatttatccaatatgacaagccctaaattttattttatttattattttattttgagacagtctcactctgttgcccaggttggaatgcagtggtgacatcgtggctcactgcagcctcaacctcttgggctcaagtggtcttcccacctcagcttcctaaatagctggaactacagttatgtaccactgctcctggctaattaaaaaatttttttttgcagagaagagatcttgctatattgaccatactgaagccttgctttttaagatgatatttagatcatttacatttaatgtaattatcaatatttttagtttagtttcccaactttctatgtctttttatccaatttattttctcttcttttccttattcctgcgttttttgataagtatttttatgattacattttatttttcaggattggattattagttacacatttttgttttattatttttagtggttgctctagggtttacattattcatcttaacaaataacaccctacttcaaataatataataatatatattatttcacatatagtataaaactcataacttccattttcctcttttatcctttgaatgatactattgtctttcattttacttctaagatgttgtaaacctctcaacaaattgtttacatattttctttagacattcaattatcttttaaaatctttaaaaataagtaagaaaacatgtctcatatttatctacacttttaacatttccagtgctcctcatttctttgtgtaaatcccaatttctatgtagtgtcatttgtactgcctgaagaattccctctaatgtttcatttagcacagatctgccatcaattcatgttctctgcttttgtttgtctgaaaaagccttttttccttcagctctgagatattttttgctggttatagaattcagagttgacagttcttttttcttttagcactttaaaatgctattccattgttttttggcttacttatttttaacaagaagtttgtaataattcttttgttgttctgtgtataatatttctatttttttggctgtatgaaagattttctctttatctttggttttaagcaatttgtctatgatatgtcaaacagtgtttttaaaatattaattctgcttggtgttctctgtggtctgttatctttattaattttagaaattctcagtcattacctgttcaggcatttcttctgtgcatttctctctctttcctttttctacatgttaaaccaggtgatattttaccacagcttgtggatgctctgctcttgtttttctcattttttgtctctttgtattttagtttagataatttttattgtcttatcttcaagtcctctgacatattcttcttctgtgttcaagctgataatgagcccatcaaaggaattcttcatctctgatatattcttccttcatagcattcccattggacttttaatgactttctctctactgaaatttcccaacttttaatgtttgttgtgtatctcttctactggatcttttgttttgttttgtttttggagacagggtcttgctctgtcacccagcctggagtgcagtgatataatcatgggtcactgcagccttgacctaccaggctcaagctatccttccacttcagcctcttgaatagctgggactacaggtgtgtatcaccacacctggatttttattttattttatttttgtagagacagggccttgttatgttgcacagactgttcttgatctcctgggctcaagtgatcctcctgccttggcctccgaaagtgcttagattataggcatgagccaccatggctggctgaccttttaagactagagtcatagttattttgaagcccatgtctaatatttttacctgggccattcttaagtataatttttttgatgtttttatcctttgaaatgagtaattttgttcttgctttttgggctgtatcatattttttattgaattccagaattggtataaaagtatagtagaatgcgatttaaatagtattttcattaaaaatggatacacatgtttttgtgtcaagtaaacattcagaatcttaaagaaaaattgattaatttattctcagaaatgtgatatatagcatacaagataagaagtttgagcaataaataggtcaaaattgtgctgatgaacttcattaaaattttaacttcattaaaaattaaaattttaacttccttaaaaattaaaaataaaatatgtaattcaggaacatatatttctaaagtatcccattatactgaatattttagagtaacagttacaatggtatgtacatggcaagtaaaacagattttgaccttttcttgcaatagtagcaaaataataacaacaacaacataaaaaatcataatggtaaagtagcttatttacaaagtgaccaggagtaacattttatacccactctcacatgtaaagtgataagtggtacagaaaatgtattcagtgggaaatgtgggagagggtactccagagatagcagggagttataatggtctaggtctggacaatcacagcatcatatccctggattataatgattgatttgggaccggtcacagaactcaaacaaagactattagctctaacaagagctgttttgggaccctttgcagttagaactaaagttgtaaaaagataagactagattgacttggtgccattatgtcaccccaaagggtgagcctgaattaaaacagccaaaacacagaaaaatggagtgatggacagcaataagtttctgataatattatttaagtctttggattgagctatgcctaaagatctttttcagttataagaaccagcaaatgattttttcctatttttaaatgtaatttaattatttatctatgtttaaatcaacagataaaattgtatgtatttattgcatgcaacatgatgttttgaagcatgtatacattgtgaaatgactaagtataattaacatgtgcattatctcacagttatttttgtggtgagaacactttacttatactttcagcattttataagaatacaatatattaactatagtcaccacgttgtacaagggatctcttaaacttattcctcctatctaactgaaaatttgttatcttttgatcaacatctccccaattccctccttgcaatcaccttatcccctagtaatcaccattctactctctacttctatgagatcaacttttttagattccatatggtgagatcatgcagtatttatctttctgtgcctttcttaattcacttaacataatgtccttgaggtttatccatgctgttgcaaatgacaggatttcccttatttttttatggacaaatagtactccattgtgtatatgtaacatttttcttatccattcatccatgatgaacacttaggttgattccatatcttggtgattgtgaatactgctgcaatgaacaccaaagtgcagatatctgttttagatgctgattttatttcctttggatattatctcagtggtgggattattagatcacatggtacttatatttttaattttttgagaaacctccatactgttttccatggctgtattaatttacattctctccaacagtgtacagggttctcttttctccaaatcctcactaacacttgctatcttttgtctttttgataatagccattctaacaggtatgaagtgatatctccttatggttttgatttgaatttccctgatgattagtgatgttgagcaccttttcatatacttcttggccattttgtatatgttctttggagaaatgtcaattcagatcctttgcctatttttaaattggggctttgctgtgtttttgttttgctattgagttaactgaattccttatatgttttggaatattaactccttatcagatgtatagtttgcaaatattttctcacactctgtaggttgtcttttcactctgttgattttttcctttgatttgcagctgctttgtagtttgatataatcccagttatctatcttgcctttgttgcctgggcttttggttcatgttaaaaaaaataattgcctagaccaatgtcatggagctttctcctatgttttcttctagaagtttcatagttttgggtctaacatttatggctttcatccattttgagttgatttttatatatggtaggagataaggatccaatttcattcttctgcatttggatatccagttttcccaacaccatttattgaagagactgtcctttcctcagtgtgccttcttggtacctttgtgaaaaatcagctgactgtaaatgtgttaatttatttctgtgtactttattttgttccattggtttacgtgtctatttttatgccagtaccaggctgttttggttactgttattttgtagtatattttgaaatcaggtagtatgatggctccaaatttgtttgcttgtttgttttgctcatgattgctttgtctatttgggaccttttttgatttcatatcaattttaggattgttttttctgtttctgtgaagaatgagccaggcacggtggcttgctcctgtagtcccagcactttgggaggccaaggtgggaggatcatttgaacccaggattttgaaaaattagctgggtgcaatggcatgtagctgtcattcaggctgctcgggaggctgaggcaggaggatcctttgagcccaggagttcaagacagcagtgagctatgattgtgccactgcattgcagcctaggtgacaaaacaagaccccatctcttaagaaaggaagaaggaaagaaagaaagaaagagaaagaaagagaaagaaggaaaagaaggaaagaaaataaaaaaaagaaaggagggagggaggaaggagacagagaaaggaagaaagaaagaaagaaaaagaaagaaaaacagaaagaaaaagaaagaaagtcattggtattttggtagagattgcattgaatgtatagattgctttggataatgtggacattttaacaatattaattcttccaatccatgtgcatgagatctctttctatttgtgtcttcttcaatttctttcatcagtgttttatggtttttggtgcagagatcttttacctccttggttaaatttatttctaaatattttttgtagctattgtaattaggattattttcctaatttcctcttcagatagcttgctttttgggtacggaaacgctactgattttttttttcccaacaaatgatttttaacttagacaaatttacactgggttttatctcctttcaaaaaaatgaggctgatggaaaattcaagagtcaatgttttttttctaagagagaaacagaaaaataaataacctggcattagggtgtagtatggcctggagaaaagagatgctggagatcagcacagcagcaagagtcaggatgataaagagagagagagagagaaaaaaaaaaaaacactaagtaaccaaagataaagtactgagtgggaaaatattacttccaataagggaatctgatccagcacaaagtctgggctctggaggaaagaggcatgagaaagaaaaatataggatagctctttttaagtcaaagacatgaactgtttactccaaattagggcagtgaagacctgagttgcagactgtctggtgatatcttgcctttctgttaggtaagcactagggtggctgagctgagctgctgcaaatgtgacataaccggtttgggactatggtgtgcacctgcttgcgctatatgcatggcatgacccaattgagattatggtgtctttagttggcttgtcctagtggcagcaggtgaggtatccagatctgcacctgaaccgaggtatttgaataagtgatagaggagcaattcaaaaggcttttctgaaagtaagtcagtgagactggttgtgtgatggatgagggacctcaggaagagagaggagtaaatactgatgccaaggatgctagcttggactctggatgaacactgacatgtgtgactttgagtttaacaattgctaaactgtgatcaaaattatgggaggcattacactgaaaggcaaaactcaaagaaaactctaatatagtattagttgaaaagtaaatgggggtaccatgaagataactaaagccatatttggtatacatttaaaatgctagaatatgtcctttggatgtgctgtttgcatatagggtacacagaaggggacttttatcttgttaggttttatttcagatatataatggctctttttgttcccagtgaatttgggatgttctatgtgttgcttaatagtaaaatatttaaatgttaaattattagtatgcaatatgtgttagtataaatcaagtactttcattgaatctctgaagataaatacaaccatgtaatgtttaattttgactgtcttgcaaacgacctgaacatcaattaacaatctaataataatagtaactaacagtttttcatgctcaggcactattctaagtgctacacaatctggtaacctatttaatgttcacaactaccctacgaagcaggtacaattagttctcccatttactgatgaggaaaccaaatcactgggaagttaacttgctgaagtcgcatagctagtaaatagtagaaaccaatattagattctaggcagtctgattccagcgcttaaactcaaacactcatctttactggctacatgttgtatattcacatacacacacacaaaatttaacaaaacacttataaacaaagtactgtgagatctatagataagaacatccagtcttgctgttaggaaatgtggctgggaaaatagaatatttatatgaaaaagataataatagaagacagtgtgtaggaagtgacagatggatggcacagacaaatcactctgcagaggttgtagagaatggggcaggggtaggttacaggacagatggtcttaaactgatggataggacctacctgtaccatctggttcctgcccacctctctaaacttatcttcctgacattcaccaaattctagccacacggaccttctttgtgttcctcaaaatgccacactcttttctgtcccacggcttttacaattgttgtgtcttctgcctggaagactctttctttaaatcttggcaaggctgcctcctttattattcagaagtcagatcattgtgccctctgatatggtttggctctctgttcccatgcaaatctcatctcaaattttaatcccacatgtccagggagggacctgtaatccccatgtgtcaagggagggaggtgattggatcctgggggtgatttccctcatgctgttcttgtgatagtgagttctcctgagatctgatggttttataagtgtttggaagttctttcttcactcttctctgtgctgctgccttgtgaggaaggtgcctgcttccccttcgccttctgctatgattgtaagtttcctgaggtttccccagccatgcagaactgtgagtcaattaaacgtctttcctttataaattacccagtctcaggtagtatcttttagcagtgtgagaatggactactacaccctccttaatgagaacttccttggtgacccaaactgaaatactgcttcactcctaccccagtccactagcctgtttgatttcattcatgacactttccttacctgaaattatctacttgctaacctgcttatggtctgtttctcttcactagaatgaaagctccacgagcaaggatctatgatgcctgtcttgttctcatcttttttattttttccctcaagtagtttctgaagtttctacctcatctacacaatctttctgggctttaaaggctatgagggaatgtccctctttgacttgttttgaagccttgggcctacttatttgtatataagagaatatttttaaatggttctcttctttatatatttaaagcatgaaatgctctgaatatcaatgaacccaatcacatttgggtaatagaaaaggctgttttcttcatagttgattctttttttaaaaatttaatttcttatttatttattttgagagagagtctcattccattgcccaggctgaagtgcagtggcatgatctcagctcactgaaacctccacctcccaggttccagcgattcatacacctcagcctcctgagtagctggtattacagctgcacgccaccatgcctggctaattttttgtatttttagtagtgatggggtttcgctatgttggccaggctggtctccaattcctggcctcaagtgatccgcccgccttggcctcccaaagtgctgggattacaggcctgagccactgtgcccagcctgtagttggttcttttgaaatgttcctctcctttatgggccaagctgatagcatttgctttaccctctccatttcgtatatttatcagccatcaaaggcttttcttattgcttggaacttaattgaatgatgtttttgtttctttaccaacaaatgaacacaagcggctttcgaaaatactccaaaaaacagtgagctgtaggcaagattttattcttcatgtgtgatatattttggtaattaaggagtcaattctttggctaaatgctgaaagaaaaatgatgattattgtgtaggataaagctgtgaattatagaatactttcaactctgtttaaaatctaattaacattaattgttacattaattttccctgtgaaatttactaactgtatacaaaatgatatttaatcttcctaatggaggtctagtgtattcgtttcagtcctattcgtaggaatatgagttgaaatggcaaagttatagttatgttgaaagtaatgaagtaatttttatataaaactaatttattaactatcacattgtaattaattaaaacactcttacttttacacaatgttcctgtttttaaagtacttttgtgtgtgtgtgatatacatatctatatgtacatatatgtggattcccacagcgtcgtatgatacaagcagaaccattaattattatttatccccatacttatgtataatggagtttccatgaggtttaaaaacttcccctgtaacataaggatagtggatcatgaagttcataatttgtgaccttattaagttctaattactagggatacttcttgttttagtttgctagggctgccataacaaagcatcaagatttagtggttaggccaggtgcggtggctcatgcctgtaattccagcactttgggaggctgaggcaggtggatcacctgaggtcaagagctcaataccagcctggcccaacatggtgaaaccccgtctctactaaaaatacaaaaattagttgggcatggtggtgcgtgcctgtaatctcagctactcggaaggctgaggcaggagagaatcgcttgaacccaggaggcggaggttgcagtgagccaagatcgtaccactgcactccatcctgggtaaaagattgagtggcttaagtgatagaagtttcttttctcacagttttgggggttagaagtctaaggtcaaggtgtcggcagggctgactgcttctaaagcctctctccttggtttgcagacggctgccttctccctgtgttttcacacggacttccctctgagcatgtttatgtcccaatttcctctttcttataaggacaccagtcgtgttggattagggcctaccctaatgacctcgcttttgcttaatcacctctttgaagatcccatctccaaatacagtcacattctgaggtactggagattaggacttcaatttatgtattgttggaggataaaattcaaccataacgcttgtgtaaattgtgaagaaaacagtaattaatgtatagcttgttttaaattttctgagtgaatgagttaaagaggctatatgaaatagtaagtgctattttagccaagaaaattatgtctcagcacatgtggtttgtgtttcaaaaatatttcttgagtaaaatgtctgatttatctaatatttttaataatgctataacctttactattttgataatggtagtactacccgacatatattgagtcttaccatgtaccagactgttttaaacatatgccctgtattaacatatttaattattacaagcaacctatggaatactattattgccctaattttaaaaatatggaagctggccaggcatggtggttcacgcctgtaatcccagcactttgggaggccaaggcagatggatcacctgaggtcaggagttcaagaccagcctagccaacatggtgaaaccccatctctactaaaaaaaatttaaaaaattaaaaaaaagagagtaaactctgtgtaagaacgctaaatgacttgtcaaaggttctacggcaattaagtagcagaattggaatgaaacccaggttctcaggctctggaacttttgattagcaggccagtggttctcaatgggtggactctagtttctggctaagatggagtaagaggaaaagatttaccatccaatgtagaacaactaaaaaatgtatctaaatatgtaaaacaatggattgtaagacattggacttcatggaatgaaaggcagtgatccctgcgaggaaccatatagttgccccactttataatcgagagaaagagttcccaggcttgatgctcaggaaggtgatacctgacccctgcagcctgcagttggaacacagcactgagagtccagggagaccaatgcaatcagagtacagggaagaggacaagagtactctgcacagggagcgagaaagagcttcacagacagtcagagggttcccttgaatcatcagaggaaaacagattagtatatacatgtgcagaaactagccatggctggggaaagaactaccgaaggactagagggaacaattgctggaactcatctggggctggaatagttcctgtccccaaatcataactcatgggacattgggtagaatattcagaagaattttgactcggtggggaaaaattagccctacactaaattatgctagttccaccttaccaagcttaaaagaaagacctgaaagggtcaaactgtttccaagttgaagaggaaagggaataaacattcacgaattactgtcatcatcgtgaagggactctggatgtgaatcagtagctacacaagaaccttcagtgtctctgagcatgggaagatgaaaagatttgcttttcatgcaaggaatttaaatttccaatgtcatatatatgaggacaaaatacattagtgtctgagtgttcccagcacttctcctcttcaccccactgaaaagagtctatccacccagattcttcccctccacagctcttcagagagggttctgctggccagattggttcagaaagaaggtattaagaattaccagctgggtgtggtggctcacacctgtaatcccagcactttgggaggtcgaggcaggtggatcacgaggtcaggagatccagaccatcctggttaacatggtgaaaccccatctctactagaaatacaaaaattagctgggcatggtggtgggcgcctgtagtcccagctacttgggaggctgaggcaggagaatggcatgaacccgggaggcggagcttgcagtgagccaagatcccaccactgcactccagcctgggtgacagagcgagactctatctcaaaaaaaaaaaaaaaaaaaaaaaaaaaaagaattaccatgtgaatgatgaacacttcccagtgtttgttgataactgaagtaaagaccttgagatagtgttggaattactgtttggttgctgggtagtatttgtttacctctcacactactttcagatgggctatgttagtcatagctttaaccagattatagatttactgattggatagatgtttactaaaaattaagtgagcaaatgcaaggactagaacaacatagacaatatattctgatttttatttaaaagaaatatgcaaaaaacactataaaattttaccccaaatatacccatcagtataccaaaagtgtaccatgtatgctaacagccatataaaattactaaaaggatatataccaagctattggtaaaaggttatctctttcactggggaccaggattgggcaggtagaaggcagtaggaacatagcaaggagatcctttcactttgtattccgtatattgatgagttgcttgagttaaataaaacaagaattataatttgtcattaaaaaactaaatattaaaaattaccatcttcccagtgtttgcaatttttttttttttttttttgagacaagtcttgctgtcaccaggctggagtgcagtggcgtgatcttggctcactgcactctctgcctcctgggttcaagcggttctcctgcctcagcttcccaagtagctgggactacaggtgtgcccagttaattttttgtatttttagtagagatggggtttcaccatgttggccaggatggtctcgatctcttgacctcgtgatctgcctgcctcggcctctcaaagtgctggaattacaggcatgagccaccgcgcctggcccaggcttcaaaatttttaaacatttaactggaatagtaagtaaccaacaagcacttagaaagtgcctagtgtttatgattcctgccacctcagagagctacatttgtgttcaatcttcggacacttaaatgttttcaatgtatgtaaataattattgttaagattttcctaatttctttgttaaaatggttcatttcaaggttctttagagcttgcatttatttcattttttgtcatgtttcttttctcttagaataaaaaccagcagtcattttaattacccctgataatgttcatgaatactgccttggcctgtcttctggtttggaaccttttcaagggcgaatggatatttgtctggtgttccatgtataacctgtccttgtgccacttttccaatgtggcaggaagggaacaactgtcatctgttctgagaattcagcactgtgtctggcactgtgggaatttacccagactgctttgggggaagacatctgacacttcatgataattgtaattaaccagaaagacactggaattggaggatttgaagggaaatatgacaagggattaagactttgagattacttttggagccagggtgacttaagcacatttaaaaagttaggtttacttatatattattattatattctaaaccataagacattttctaataaggtttctaagaggaacatgtaaacctggatcaaatttaaataaggttactgaaaatattaatgaaaccaatgactgagcattttataaatgagaactgtattgctttaagttggagaaaagctgcaagtaagacaacatatttcttcatttgaaagcttgtgtccttatatgagggacattgacaaatgagtggtgataaaatggtggtctatgtgccataagggcttaggtacataaattaatgttttattaaccataaaaataaggttaaaaggttgaaatgtagccttcatgtgtctatgtaaaaaagaggcagaaaaaaatcctcagcactctagagaagcttagtctctgagcaatcactgcatatactaatatattcacatataatctagaatgaatgttaaataacaaaaatcatgttcgtttttatattttgctttgcctttgggatacgaagtgatggaacgagctcgttaacactgctcatttctggttagaagaacactagaaccacctagtggatttttcatttattgcatgatccctacactttactattgctaaattgttaattgctgagataggccttaaagtaaaatcagtggttataatctctttgtgggtcataatagaaatagtaattgttaatcttcagcagacaaagctgtccctaagtccttgaagggaagtccctgcccaccaaatacttaccaactagcacactgctgcatctagaaaagcacaggcagagttaaacatttggctgctgagatacaccgtgcaactggagctttaaatttcctgtgaaagtcagtgagcaaggtaaactgcagcaattcatctgcattcatggcagagtcaactttcggtgagcaagactagggaactctgcagagcacagccaaggggctacattagcagcttgacctttgtattcaatataaatctgtgggcacacaaactggcgtttctaatcaattttgtttttggagcaaagtagcttatgtggttacagcgtgccctggtcattctgtttcccattgctgaaccaactgggtctccgcatcttggtggtgatgacagatgttacgtatattacattgggatttgggtcagataaatagcaaatattctgggaaaggatactttatgtttttgcaaaaggttataaaataccaaactttagtaaaccctgattctaggccaaaggttaactctttatatctatgatttattaggtatcaaaagaaaaaagtcaggatctaaggggaatggaaaagtttctgctattctaacctaagagctggttgtcttctcctagtaaactaactgttcagcagatgggatgcatcgggctacaaggttggtgctttccagccggcaccgcgtgtgaagggcatgtggttgggctgggctctccaagtctgcatggcttgggttgactataaccaggggaaacacgcagtggctacaactgcttctcctaacaattctcgtttcattctcttctcccacagtgtgaaggaggctaggtggatattctctggggcttgaaatttcacactgcaaattttacgagagtgatgatctcttcctaactctttagaagccaagataggaaaaatttcagtttacaagaataaagcccaatccctcttcttatgttggaatgtccagtaaaatgctaagaaacgggtgggtagaagaagaggaaaggaagaagagaaacagagaggagagtaaggaaaaaatagaaaaggcagaaaaaaataatgtacatgaacaacaacaaaaatagtgacaaacagaatggactatagagataggggagggtagtgaagggcttcagagaagtcaggtgaagggccttcttttcttttctttttctttttcctttttttttttttttttttgagatggagttttgctctgtcatccaggctggagtgcagtggcataatctcagctcactgcaacctctccctccgggttcaagcaattctcttgcctcagcctcctgagtagctgggattacaggtgcccaccaccatgcctggctaatttttgtacttttagtagagacggggtttcaccatgttggccaggctggtctagaactcctggcctcaagtgatcctcctgccttggcctcccaaagtgctgggattacaggcatgagccaccgtgctcggccagggccttcttttttaaagaaaattttattatgctgtgataagaacacaacatgaggtctaccctcttaaaaattgtgtgcataatacaatactgttaactagaggcacaggttgtacagcagatccctagaatttattcatcttgcataactgaaacttcacccctgttgattagcaatttcccatccttgcaccccagtccttggtaaccaccatttattctactctcgcattatgtgaaatggactattctagatacctcctcaaagtgcaatcttgcagtatttgttcttctgtgactggcttatttcacttagcataatgtcatcaagtttcattcctattatatatgtcaacattttcttctttttaaaggctgaggctgagtaatattccgctgtgtgtgtgtgtgtgtgcgcgcgtgcatgtgtgtgtgtatataatattccaatttacgtattcatccattgatgaacattttggttatttccacatcttgttttttttgaatagtgctgcagtgaacagtgggatactaatatttctgagatcctgattttagttttttgtgtttattttttttgagacagggtctcgctctgttgcccgggctggagtggtggcgccatctcggctcactgctgcctcaatctcctgggctcaagtgatcttcccacgtcagtctcctgagtagctgggagtatagaccaccatgctcagctaatttttgtttattttttgtagagacgaggtctcactatgttgcccaggatgatctcaaactcttagactgaagcgatcctcctgtctcagcctcctaaagtgctgggaatataggcatgagccaccatgccaggccccagtttcagttattttagataaataccgaaaagtgggattgttggatcatctggtagttctatgttttcaatatttttaatttttcccagcttttttgaggtataattgacaaaaattgtatatatttgaggtatactatgtgataatttaagttgtgaaatgattaccacaatccagttaattgacacatctgtcatctcacataattaccatttgtgtgtgtgtggtgagaacatacaatatctactttctgagcaaatttcaagcatgcagtatggtattattaaccgtaattatcatgctgtactaatattggatccctagaacttaattcatcttacaacagaaagtttacatcctttgctcaacatctatttctcctacctctggatctctggtaaccaatttctactctctgtttctaagagttcaacttttttagatttcacatataagtagaatcagacagtatttatctttcttcatttggcttatttcttttagcatgatgtccttcagattcatccatgttgttgcaaatggcaggattttcttctttttttaaagactgaataagattttctttttatgcatacatattgtctttatccattcacctgtgatggacacttaggttgtttccataccttgactattacgaataatgctgcaatgaccatggggatacagatatttcttcaagatacttatttactttcctttggatatagacccagaagtgggattgattttattatatagcagtgttgttcttcactttttgaagaactgccatactattttccatagcaacagcaccattttgcattcccacaaacagtatgcaagggttccaatgtctccacaacttcaccaacacttttctcttttcctcggagctttttgtctgttaaaccccagcttcccccagcctgaagcatagttgacaaagattgtatatatttacagcgtacaacatggtgttttgatatatgcatacattgtaaaatgattcaatcaagctaattaacatagccgacacttcatgtacttatctctctttttttttttgtgatgagaacattggctttttgatagccatcctaatagatgtgaggtgatatctcattgtggttttgatttacagtttcctgattaggtgatgttgagcatcttttcacattcatgttggccatttgtatgtcttctttggaaaaatgtcttttcaggtcttgagccccgatttaattaggttattagtatttttgctcttgagttttaagagttccttgtatatttcagaaattaaccccttctccattacatagtttgcaaatgttttctcccattctatggtagtttttttcattctgttgtttcctttgctcacagaagcgttttagtctgatgtagtcccatttgcgtatttatgcttttgtcgctgtgctcttggtgtcatatctatgaaatccttgccaagatcaatgtcatgaagattttcccttatgctttctcccagtggtttcacagtttcaagtcttacatttaagtttttaatctacttggcattgatttttgtgtacagtgtaagatatggatccaaattcattcttttgcagttggagagccagttttctcaacactatttgttaaagaaaccatcttttgcccattgtatattcttggcacccttgtcaaagatcaattgatcatatatacgtgggtctatttctgggctcctgattctgttctattggtctatagtctgtctttatgccaataccaaagtgatttaattatggttgctctgtaatgcattttgaaatcaggaagtgtgatgcctctagctttgttctttctcaaaattattccggctactcaggggcttttgtatttccatataaattttagaattgttttgcctatttctataaaaaatgccatcgagattttaataggaattgcactgaatctatagattactttcggtagtgtggatacttccacaataataagtcttgcaatccatgaaccaggatgaagggcttctatatatagggcatcagttctcaagattggctgctgggcttctcagagcccatgaagataataatgagacactgttagttaattttaatattttaaagtttgatattctatcttttaacgtttacaggaatttgaaattgtatatttatgtgtgtacctatttgtttcatggctctatgaaggcaggaccatgtctcttttactcaccacagaacaactagcaccactgttgtgcagtagagcctgatggttagagctgcacgcatgggcagacctcccggtttgccatcctgctgcgaccactgactaccaatggcacatataccaccaattggctaggctaacaaacattccaagccccattttgccttgttgccttccattatagaggcttgtacaagaaaaaaaaccctacattttactttcccactctcatgctgctgggggatggtcaaaggacacagacttggccaatgaggggttagcagaaagctggcgaaggattctggaaaggctttgaattcctgctgaaaaggaaaaatgcagttgacagatgacactaccctctctcttcttaacttaaacgtggatgtgatgcttggatataggtccgccattctgtgcttctgagggaaagagtcagtcaattctcagagggagcagctctaacaccgtggagccatggaatgaacactaggaacaaatgacctcccagctgattgttatatgagagaaataaatgtccatttgtttcagccactgtacatagggctttctgttctttttcagcaaaacgctcctattacagcagttttgtgacttcaagcaagttactttactctgttttaatgttcccatttaaaaacagggattataccaatatcgtcctcatagggttgtttgaaagactaaatgagataatatacgtaaagagcacagagtaagcactagatagggataaattactatttttattactattttgatgatgggctcttaataagtcttagatgaataagtggagtaggtcaaacccaaagggtatggcttcaacccaaggcaacccaaggcaacccaagataactcatttttttctgtttgagaaaaatgagaaagggtggagaaatgagaggaaggtggggtgcggggaaggaggcagggctaaagtggagccaggtgggtgctgggtgggggggaaaatgccctatgaaaatctcccatggtgaatggtcaatgtgttggggccaacatattggccatgtgtggtccaggcatgccagtatcaacagacactaaataaacattttttttttttggctcattgaataaatgaatgcattgtgagggtgttcattaacaaagaaattgccatctcatccttaaaactgaagagatagaagtgagagggcagaaggtttttctccagtgtcactcgcacacctattataatatttgcctggaattatgtgggtgaagatgcattgctcaataattgcctgtgccctcgcaaggagcagaggagaacatccggtgggagcagaagcagaggcagaaagaacagatttcccacggagtaaaatattctgttctcataaaaagtcccttgctgtaacaaacgagaaaatgaaaaggagagcctgtagaagagaggcagacacctcttaataggcacatctctccaaagtttcccaccaggggccaactgttcattaaacagggaacaaatgcgggagcgtagctgtgatgggctccattccacagcccagtgctgggactgcagtgcgctaggaagggcgtcgctgttgttgctgtggcccggtgtgacagcaggtctggcatgtcagaatcgccctgcacaaatagctcctgtgcagctgctctcacccaaacctgctctgaggaggctcagtgcattctaatccttcctaaaaacatggacagaaagcaatggaaagttgacatgtataaaaggtttagtcatggggtttttaagtggatgcctccatgaaaggatcaactcagatggccacgtttctgaacattatttacatcaaaacctgacataaatgcctcagatctagctattttcttcctctatcctctttttacatgtctccttttccctctcgattgctttagcttgtaacctgcatgcgctttcaaatgtggtaagcaaatagaaagcaagacgccatttgaatagtgaatggacttgtattcctgtttaggaatgtgtagttgcccttgggctttctcagttataagactcataaaataaaaccttaacacagatggaacacacacacacacacgcacatgcaccacttaaagcagatgtgagtcaaaaacatatgctgatgaactcaatttgctgatggcattctgagcagtgagcccactcagtagggctgaagggttggcatagcaactcttcctgggaaaaaatagacagctggaataaaccatgacgatgaaagtcttcttccaatgactgaagaagtagagagaaattgccatctcttctaaccccttcaagcaaagcaccttggttgaggtttatagactaggatcttacaaattagaagttcatgtattttcctaggtcagattctataccttgggttatattccagctaagaaacactttcagataggctgcatggggctgtggggaaagagagagcacaaacctccaaaaagcatggagctttgaccaaagtttatttctgtaacttatcctaaggctatgccgagtgaagacttgtttactctagctgtaacttactccatcacatagcaccattactttgagaaattaacatattcattctcaattatttatcaagtatccagcactagcaatagggacacagtccctgcttttgagggattcatgactaggcagacagcaccctgagtatattaattaagatctgatcccatattagaataatatgcacaagagacttattacctctgtctcctcattcctataaacatttatctgggacctatcttatgtggactgtgctaggtgcaatgccaagggataaagcaagttaaatggcaacagtcctattcgacaggccagggactcaggatcagactcaggaccctttccctcttgttgcaaatcctgctatgtgtgggctcagccccaaactgtctctgaaatctcagaaatgagcaaaggctaaggatgtcaaattggctttgagatatgcctgtagactgataacaatagtgatgatgacgatgatattagttaatacaataaagctaatactgtgctattattaccaggcactgttctaagtactttaaataacttatttcatatactcttctgtcatttagtatgcataccattattctccttcccattatccatatgaggaaagcaaggcactgagttaaaacgactcacctttaactgttcatctatcaggtaagctaaccccggagcctacataaattcttaactattaaataagctatgccacttctcaaccactctgctgaaaactatacaaactgacaggtcctacaattaaaacccaaaatagatataataaagcataaaaaatcagttaggaattttctcttgcttttgctctgctgttattgttgttctccagataagtcccattttaaaatccacagtcaccttaaggatgtgatgtgggagctggagctgtctgcctacccaccagctatttttaaaggaagatgatcaggaactagttatgaaagaatcagattgtttaatctggtaccacagaacttgagaaactatagacttggtaagttggaaaatatgtaggcagaagtgatgtctctatggaaacagatgtgaagattcaagtaaatactaggcctgttggactttttatgaagatagcagaagcttttttccccacttcttcttctataacctgtttattgaggaatctgaccatggtgaggaacaagctagagacatatttttatctctagtcactgcttccaactctgctatgtcgaatctcccaactcttctagacatctctcaatgacatcttggacaggaaccatagtcacttacagtctagtccagccttatagcatatgcaactgcatatccagttcaagattttccattgctccattgatggctacacttattactcaaggatctactgtgggtgtgcttaggggtaactctttcaccttggagagtggtgtgggaatgttcttgttctagtatacttcatcccaaagacccaattcctcctgttttggggactgggagagaagatgagatggcttaatgtctcttggctttctctattgcttttgctgtctctctagcataccctagcgaccactgagactcttgtggggcagagatccacacgttatctatcttagggacatgatgggttcttcgaagtccctcatgagaggcgtgactctggctcaaacatgttcagcccccttcagctgtccaagcccccccaccctctatcagctctaactacactgcttgcatttttctttcctggtgggctgctttactggcatgtggaggagtgctgatatagcaggaagagttttgctacttcttattaagtcctgaaaaggtatctggtgggtgctgtgtttgtaataagatacttagcacctgtttcccctcgagctttgggcctaggtatcagttctcagacaaaaggaaaagtcaatttttataccctattataatgataaactttgattgaaactttggggataagaaagcatcgagatgtttctctctccttctattcctcttttctcctccctccctctctccctccttcctttgctcccttctttccttcctttctttcttccaaatagcaaccatgtaatctaaattatgaatgataaaaaagcctggcaaatcaatgagagaacttagagcaaaggaatttggaatattataagatagggaacaattttagtttcctgagcattttggttgtattaccacctgctccaatcatagactgtactttttcatgcccagaaaagacttctacaacccagccttcatagcaatcagccactcgggactttcttgcagtctgagctcaacctgtcttattttgctctgagttttccagttctgaaggcttgattactggtccaagagtgtcatttaggtagatatgctgaactcacatcatcctcgttacaaattgttatggaaaatcccaaaaatataaaagaaaaaaattttaaaaactagctaagggcactgttcacatgctgcaagatctcacggaggagaagatggaatgagtggaggatacacttgctgtgtgttcatcattgaagaagggaaagagcttgtgaaatgacccctagcagaaactcactggtgctttcaagttcagggtggcagggttgaaggtgagagttagcttcagggaagatggtggagaagaatgtttgctagtatctggaccccaaaggattacacaggatgctggagcctgcatgggctaggaataccattagttcaatcatggtctacacttggcaaggaagatgcattgagaataggtgaagggcatagtcaagaccaatgctaactgtcattccttatggaggaattatggaatctacttcaggctgccatgaaaagcaaagcagagaatctgttgggacaactcgttcagcagcctcagactacagctgcatctttacttatctaggcctctagatcactcagaagtaaaggaaaatttaaacaaatctaaacattctcattctttcactggggtcttcaaagttttgaacacaatctctcagaagaatcaatttctgatacctgaatctttgtaagcacgaacagagagaagggactggacagatgaaaaggatttgtagttcaaagaagagggccattgtggggaactgatgctgagctctcggttctatgccccccagacttccttcttcagttacggtccctgcagaatcagcatccatctgcgactctcctttattcattgaactccttgttttggagaggagaggcatattttctactttatgtagctctccagcccatgatctcctgtggtcaggggctaaggattcctttccctgtttcctagtaatgcataactctatctctccataaggcagggtgggccaggcattcagaaagttggggaagctaggcagaatgtgaaataagtgaagggaattgaagggtgctggaaaacctcccatcaaaatttcctcccccatgttattccaccattaggtaattagctccctggttcttaaaggattacatcacttttctttgttaagagttgagtcatctatgcaaaaaaaaaaaaacaaacaaaaaacccaaaaactgagtgaattaaaaccagaatccttattagttattacctcaggagctttaacagtgtcccacttcaattagagcaaagctcactgggaatgtgtgtaggataaagaagatgttggaggtaatagacattaaggaaggggccaggagcgtggagggaacccaagagacgtgggaggatctcaaaagtgatctttgcctattgccaactgtgactgaggccctggcccatcatttgatgttctctgtcattcttgggagaggcagaggagtgtgatgattaagagcatggactctaaagctagacttctgggttcataaagggtaacagcttagctctgccccttcctaccttggggactttgagcaaataatttaaccgctctgtgcttttttcttcatttataaaacaggagtaatattggtccctgcctcaaagggttgttgtgaggattaaaggagttaacacacataaaatacttagaagagcacatggcatagagtaaatgctagttgttattagtatgctttcaatttcacaaagggacttaaaaggtcagaacccttacttactcctaggaaccactggggaaggagtgaggaccaacatatattgcatatgtatgccccagatactgtatataaaatatctcattgaaacctcacatattgatgaaataggtattacaatatccctattttgcaggtgagaaaactgtgtctcagagggtgagaatctggcccaaggtaatacagctaaaaagtggtaaagttatctatgatatcccacaatgttacttacacagttctctttggaaataaaaatataaacaaatggtacaggcagattaagaacaactccagcattattattattattattattattatttttttttgagacagggtctcactctgttgcccagattggagtgcagtagtgcgatcatggctcactgtagccttagcctccctgggatcaggtgaccctcccactttcaagtagctaggactacaggtgtgagcttttgtttttttttttttttttttttaatagaaacagggtttcaccatattgcccaggctggtcttgaagtcctggcctcaagtgatccacccacctcggcctctcaaagagctgggattacaggctccagcatcaaatgtttacagtagttgtcctcacagaaaatgcatacataactcttatcttcctgactcaatgctcaccttcacctcccaccctgactgcagcctattatccctgcagtcagtggacttttaatccagataccttggctgagcaggctcatagaggaaactggcccacagaaactgtgagaaataaatgtatgttgtttgaagctgctaaatttgtggtaatttgttatacagccataaaaacgaaaagaccaaacagtcatatcctgaatgattaaaaattggttgcataagtaaaagaatgtatttgagttggaagatttggggttttcacatgaaaaaccaagtgtgagtaaaataaccgcagaatagctattttggaattctgatactcaaacacttgctagttgaaggagtgctaagattatggatataacaattgattctagggtttcaaaacttatttcccataacataggaaagctgaaactctggctataaagaaaaggctatttttctttctcttgaaataatttgtactattcattgcactgtcaatagccaagaacatgctagaaattacaacgtgctcgcacatatgggtatttctgctatgatgcaacatatatgtttctaaaattcattttgttttgcaaaatcaaccaatagaaaaacaaaggacttataagaaaaatagggttggggcacaatagtcacaaactgtcagtaacacaaaacaaaaagataaaatctaatcaaattgtggtagcacagtcttacacaagtcaaatgggtaagaaatatgtaaatactacaaaaataagacactttcctttgacaaagactttacatttgcttgtggaagtgggagtcagagcattgcagcttgtgagtttttgtgaaattgtggaaggaaggtgatttgaaatcaagggaaagttgtatcactgatgtggatggatatggcccatgttgagggtggtggactgaggtagctgacatgtttcaggtacgtgcatgtctgttttgtacatcttacctggctgggttcaggtgtgtgcaattttctgtgtttccctagtgtttttcatagactaaacagtgcataagcaaccccaaattcgtgttatgctcaaaatgttctctaataaaatcttgtgtcttgaaaacaagtgttaaaaagtaaaactgaccagatgttatttcatttgaatcttacgataaaagcaataaatagacatgaggaaacagctttagacatagagctagtaaacagtcaaggcagattgaactgaggtcttcctcctctgtgcttttcccattaggccactccaggaatgtctcagtctagcatattttaaatctgtgtgatgctatagtttcactactgcaatttctaagactttatattttcaattagacatttattttactaccaagaagtatcctgatccagaggtactattctcccagccatggagagttcctccaaaagacaaaattctatctttgctaatgaaaatgcaaataaaactgtatcaagagtttcatgattttactaggtatttcccatcatatgtttatcatacagctcaaaattgatgtcaagttttttactctactcttttctcaagttcattcactataaattgaatttcatttttctgcacttgggttgtattttttgaaccactgactttgcttatattagttttactatgatattcatcaatttgtttaaaaaaattcagaagatacctcttgcacaaattcattttataatttaagaactcacttcagaatgttgagactctgttaagtatcaattctaggattatgaagatcctgtctaccacaaagagccccacaaaggtcttttctccctcattcccaagcagtttaacttaatgaattcttctggtagaactttgtttagacggacttaaagcaggtaagagttctttttaaaatacttgtggagtgcatgagtgtgcaaacaaacttaaaagcacatattggctcaggaaagctgaggggaaatgataattttcaacagtccaaaatagccatcctggggcttacagaaagtaaggtagcaattagcctaactctaagcctaacaataacacagtcattaatcctgggtgcccagacacattccattagaggattttggcaacaaaattttgcttttctaattctgagtagatataaacaataatcccttaatttattagtctgtttatcacacttattaagcatttcctatgtcttaagaactgtgccacaagacaaggatgccctctcttaccactcctattcaacataatatgggaagtagacataaacaataattccttaatttattagtctgtttatcacatttattaagcatttcctatgtcctaagaactgtgccacaagacaaggatgccctctcttaccactcctattcaacataatattggaagttctggacagggcaatcaggcaagaggaagaaataaagcgcatccaaacaggaagagaggaagtcaaactacctttgtttgcagatgacatgactgtatatctagaaaacctcataatctcagtccaaaagcttcttaagctgataaacaacttcagcaaagtctcaggatacgaaatcaatgtgcaaaaatcactagcattcctatacaccaacaacagtcaagctgagagccaaatcatgaactctcattcacgactgccacaaaaagaataaaatacctaggaatacagctatgtagggtggtgaaagatgtctataaggagaactacagacttacaaatcactgcccaaagaaatcagagatgatacaaacaaagggaaaaacaatccatgctcatggataggaagaatcaatattgttaaagtggccatactgtccaaagcaatttatagactcaatactattcctatcaaactaccattgacactcacagaactagaaaaaaactattttaaaattcatatggagccaaaaaaagaaaaaaatccagaatagccaacacaatcttaggcaaaaagaacaaagctggaggcaccatgctacccaatttcaaactatactacagggctacagtaaccaaaacagcatggtagtgacacaaaaacagacacagagaccaatggaacagaacagagaatccagaaataagactgcacacctacaactatctgatcttcgacaaacctgacaaaaacaaacaatggggaaaggattccctattcaataaatggtgctgggataactggctagtcatatgtagaatattgaaactggatcccttccttacacgatatacaaaaactaactcaagatgaattaaatacttaaatgtgaaatcaaaaactacaaaaaccctggaagacaacctaggcaataccattcaggacataggcatgggcaaagatttcatgatgaagatgtcaaaagcaattgcaacaaaagcaaaaattgacaaatggggacaatttaagctaaagagcttatgcacagcaaaagaaactatcaacagagtaaacagataatttacataatggtagaaaattgtgcaaagtatgcatctgacaaacgtctaatatccagcatctataaggaacttaaacaaatttacaagaaaaatacaaacaactccataaaaagtgggcaaaggacatgaacagatacttttcaaaagaagacatatatgtggccaacaatcacatgaaaaaagctcaacatcactgatcattaaagaaattcaaatcaaagccacaataagataccatcttacaccagtctgactcttactataaagttaaaaaataacagatgctggtgaggttgtggagaaaaaggaacacttatacaccgttggtgtgagtataaactagttcagccattgtggaagacactgtggccattcctcaaagacctaaagacagaaataccactcaacccagcaatcccactactggttatatacccaaaggaatataaatcattctattataaagacacgtgcacgttgcatgtgtatgttcattgcagcactattcataatagcaaagacatggaatcaacctaaatgcccatgaatgacagactggataaagaaaatgtggtacatatacaccatggaatattatgcagccatataaaagaatgagatcatgtcctttgcagggacatggatggagctggaggccattatcattagaaaactaacacaggaacggaaaagcaaatacctcatgttctcatttataagtgggaactgaacgatgagaacacatggacacaacacacactggggcctttcggagggcagaggatgggaggagggagaagatcatgaaaaataacttaatgggtattaggcttaatacttgggtgatgaaataatctgtatgataacccccatgacagaggtttacctatgtaacaaactcgcacttgtacccctgagtgtaaaataaaataaaataaaaagaactgggtgccagatgttgaaggaaaatagtaagatcttaagaaaatggctttggccgggagcagtggctcatgcctgtaatcccagcactttgagaggccgaggtgggcggatcaggaggtcaggcgatctagaccatcctggctaacacgatgaaacaccgtctctattaaaaatacaaaaaattagcctggcgtggtggcaggcacctgtagttccagctactcgggaggctgaggcaggagaatggtgtgaacctgggaggtagagcttgcagtgagctgagatcacgccactgcactctagcctgggtgacagagcaagactccatctcaaaccaaaaaacaaaaaacaaacaaaaaaacacagcttcaagtttgtagatctatggtcattcagtctatgacactgaacacttcctttagtagctcacttgttgaataacatctagaattaaataggagaaaaaattttcctaatagaactataccaggctttacatgattggtagtcttcgttcttcacaaaccagtttattttaatagatatctcaggtagagttttatgaaggcctcaaagcaattaaaacttcatttgcaggaaggacaatcttatacttaccagaaaactacagctaacatgaatttctttgttagacatttgctatgaaggatctttgagaaaattctgtgttagaacccatgacacccctaacatagctatgccattatttttttcttcttaaatgaacagatgagttttgtaagcaaagtaggataccatgattgatagacctttttgtaaagtatactcagatttgctgaaagagcctacataattcagtctgggtgcagtggctcatgcctgtaatcccagcactttgggagactgaggtgggtggatcacttgagatcagaagttcgagaccagcctagccagcatggcgaaaccctgcctctactaaaaatacaaaaattaaccaggcgtggtggcacatgcctgtaatttcagctacttgggaggctgaggtaggagacttgcttgaagccgggaggtggaggttgcagtgagccgagatcatgccactgcactccagcctgggtgacagagtgaggctttccctctctcaaacaaacaaacaaacaaaaaaaacaaaaaagaaggagattacataactcaagaaaaccatactcgaagcctctctttttaaataatttttatctcaaataagggaaaaatcaaaatggaaagaggttatgatcagtttcaccattggcctacagtattgcttcagagaacaaaataaaagggttcttgcctctccccttgctggaactgggcctgccccagggacttggctgtagggttgcaggtactttccctgtcctttgatcttaatcaccaagggagcaattaaagttccatgtccaggaatcacttagtaaagagtcttgcttttagttagagagttgaaggggttgtgggcaatatctaaatatgctttggacattgtatttgatggggttgagaaataaaaaaaaaattctaggctcctaactaactgaatggattcccctcttggccaagggtgaaactgcctttgcaaaattattacacaaagagaaatctaacatagttgactccatcttgcttctgacttccaagctgtccttggtcattcctgggtgtaggccaagctcactttgggaggaatttagtttatagttttaccttaaaacaaagatgataatagcccttctcaaaactaaatcacctttgtaaaactaatggaaaggcacaaggttaaaattatgagagaggcccgaattctgataggataggcatagtttttatcagcccttacagatcaggaatcatgtgaccagaggtcacaagatttgtgaccttcccatttactcctatagttaacattgctatgttagaacccaagattgtattttgtgggggatgttttccagactgatcctacctgaacttgtgattcatgactcaattgatcctatggcctcacccagaggtagactcagcatacgaagactgttttccataccagtatgattccatccctaaccaatcagtggcacccattccctagccccctgcccaccaaattgtccacaaaaaccctaagctccaagccttcagggagactgatttgaatgataactccagttctcccacgtgagttagctttatatcaaatgaactctttctccactgcaatactgtggtctcagaggattgatctggtctgtgcagtgtacagtgctgggtgattaccagagaaactcgggaagctgagttcatggccttggcgggatgggaggttgaactagtctcactagtatgtaatcacttgtctcactgctgtcccctccccaccttttttaaaggaaaatgtacaaatagtaaacttcctgagaccctctttggaaaaaacagccatagatgcatctgtgacttatgtttttcctggacatgccctcaagctggctcgataaaccttgatgactgagatttatgactcagtcactcattttgattgtcacagtataaagggcctgctatggtctgcatgtttgtgtctctccaaaattcacatgttgaaatctaatctcaaatgtgtgggcattcagaggtggggcatttacaaagtgatgaggtcatgagggtggagcccttgtgaatggaattaatatccttctaaaagaggcccaagggagcttgtttgccccttctgtcatgtggggacacatagtaggcaccatctacaaggaagggtcctcccccagacacggaaactactgttggtgccctgaccttattaattatgattgagacaatcaaatatggtctggctaagagaagaatagtccataacattttgatgctgactccctaaagtctatgttttgaaatattgaatatttaacatgaagagcaaattacaattaggacgtcttaggtccatacaaagtaatattctatggactgcctttggaattactaggtttggtcttgggatcagattgaatgaactcagtatagattctgtgtcacttctactcatgaaacacatttactgatggttaatctaagagtatctttaggctaggtacagtgcctcacacctgtaatcccagcactttgggaggccaagacaggcagagcacctgaggtcaggagttcaaaccagcctggccaacatggtgaaaccccatctctactaaaaatacagaaattagctggatgtagtagagggcacctgtaatcccagctactcaggaggctgaggcaggagaatcatttgaacccgggaggcagaggttgcagtgaactgagattgcgccactgcagtccagcctgggtaacagagtgagactccatctcaaaacaaaaaaagtatttttatatatggcaacatgttgctatatagttatgaaataaagtgttgacaaaacttgactgaatgtaatcatagtgaagccaacgttatgtgtcatatgtcacctgtgcctgttttgtcacaagtgctctttacaaaccacttagcatcttcactttgaggttgtatgctcttatttaatgctccatagagttttgagattgttgtgagttttctattcaacattggcttctccaaagatttgatcattttttaaaacagctgtaaacctattcaaaatttatataacatatatttaaaatataaggacgctttctgatttcaaatgcatctcatgcagttaataaaattggtaattggtaatttagagtcacagataactctaagtaagtcaattaaaactgtgtaagaatttgaaaagaggatacagggcattgaggggattgacatttggtggccaagtcattatagctattgtttggaagaatctgatgatattcaaatgatcaaagcaagtattttgaagaaataaatgatgtgaaataactgataaagagatactttaaactgacattatcctacacttaaatataataaaaatacacagtaataaagcaaaataacagatttgttgtttggctacaacatcaagtcattctcaactacatattttgacaatagtgactctaaatattttctcaaactaagctttcctaaatattttcccaaaccaagctgtttctttacggactttatatgcattaattttatatgaatgactatttttctaacataaaaacaatctttacaaatattttgagaattcaggaataaaactaaagcattcaaatgaccactgctcagttgtacttgagagattttgcccaaaattatttaaaagtgttgaactgtagaaggccttaaaatagaacttgtagaatttcaatattcagaaagtaaagtttgttactatgggtcatactgttgtgaaaaagcagaaaaagaattcagaataatcaaattgaaactattttgctgatataatcaaatatgcctgatgtttgttgtggttttaaagactgtattttctctttggacatttctccatctttctttttttttttggtgtaaaatatacacaacataaactttccctttttaactacttttaagtgcacagttctgtggcattaagtacatctacactgttatgcaaccatcaccatcatccatctctggcactttttcactattcccagttgaaactgtacccattaaacaccaacttcctatttttcccttcctcagcagtcaccattctactttctgtctctgtagattgactactctaggtaccttgtacaaatggaatcatataatatttgtccttttgtgactggcctatttctctattgttttactaacataaaagtattttatctgttattaattttatctagtcagaaactggaaacactgacagaatctttggctgattaattacactacaattgacaaaatactgcccaaacataagtgatttactaaaatatgggacatgatgtttaaaattaaaaacctgatgaaactgtagtgtcagtctcaattgcagttgtaatatttttcctatagccaatgattaaaatgtgcatttgttagtgattttaaattaatttatattaaatttactattttcccatctaaagcagaattaattggtcatttttttggcacatgaattaaaacatatatacactgtctttggtttgctaaaagaatgaatgaatgatataaaggcatctcatgtagaaagatttgttcttgttaattagcaggtttattagaatatggtttctttcatctgaattttggagattggaaaaacaatctccaaaatataaagaatgcagagaagtgcaggagaagagagaatggtaagctaaaaattaccatcaaatgctaagtgtcagacctacacaaacacaaaatttaacatacttaacagtggcatgttcagtgaatatgagcaggagacatgagctcaaatctaatgatatctatgatgccagaaactttgtatatgctgaatttaatccttatgacaactctctgagtcatataatttccccatttttgcagatgtcaaaactgaaggtaagaaacggtaagaaatttgcctagtctcaacactagtcagtgtcagagccagaattccaattcatgtctacatttccaaagcccatgttgttcccatgacacaaaattgtagcatgccttacacttattgacttgggagagttttttttcttaaaaatatagtatcaatataattttagcaaatcttactgccattagaaattggtaacatttatttgaggatagacttcaaaatctttatgagacataagaaaatgaagttccagaataacaggaatttgaatggtagttttcacctttcagaggatggttttttgggggtggtaagaaacatctaagtattggttctcatttgggggcatgcttagaggcatcagtagtttctggtaaagtaagggtctttcaaaagaaagacaaatgaatgatactgtataggtgcagttacatcataggcaccacaataaggtataaaagtaaagcattatgactttcaccttgggaaagaactttgaaatgaggaaaacaaaattgcccaataaaggtgatattttataaccaaccagtgtggactagtggagcataaagtttctttaaagacacaaaatagctgtagcttggattgcacatgtggatacatcaaaataaatatgtgtcaatcaaaagtaatatatgagagtttctgctttggcacattctaacttggtgttatcaaccatttacatttttcataagctaaatagtacgaaataatctcatacagtggttttaatttacagttttctaatgactagtgatgtggagcatctttttatatgtttatttatcatttgagttttctcttctgtgaactgacagtgcatatgttatgcaaatatccaaccttcaatgtccaattttgaagtcttctaatagatgtgaaatttgtgtatagattcttttgaactctacctagacaacatgggagagacggagatgcttaccaaacccattctcttcttcccaggcacacagttacagcgtgtttccccatctctcagttgttttgccatgtgacggactgaattctagaaaatgtaatgtggacagaaatattgctatacctattccataaaacttcccacaactgaaccttcattgtgttttaccatttaccagctggttggagaggatcaggatctaaagggggtcacaggtgagacgagtaatcatgtgaaaggctgcacaacagagaactcccacattggactataatttgaatgggaaattaatctattgggttaagccactgaaaatttgaagtttatctgccatagcagctaatattgtcattaactaatatacactatgtatcgttgtgaataatgactattttgtttcttcctttacaatctctatactgtttatttcccaggagttgacattttattatgttttgtttctttcttttcacttccccgccgtgtcacctaggaactctagttcaatgttgaataaaaaattttgaaagtggccatctgtgttttgttactgaatttcgagggtatgttgaagtttctcttttaagtggggttttcttttcttttttttagagtcaggggtctctctctgttgtccaggctggagtgcagtggtgtagttatagttcattgcagcctcaaactcctgggctcaagggatcttcctgcctcagcctcctgagtcactgggagtacaggcataagccaccattccttaagtaggtttttcatacataaacttaattaggctaagaaattttccttaaattcctagtttactaagaaaattttactgtaaatctgtattgaattttgtcagatgttcataggcttgtattaacatagtaatacatattttttggcctttaatctgttaatgtaatgaattacataacagacttttccaatgttaaactatcgtacattcctgggataaatccccttctgtttttacatattattgttgtctaatattttatataatagttggccaatataccaatgtttgctatactgcttttatatcactgttattggttatttttttcattcttgatttacatggccaatgttcatttggttttacttacatatttaccagtttctttactcactactgtctctttcttctcactttttcctttgagttcagctttcttatttctgaattacagtcttcacagttcttcagctaatagcaaagttttaaagtctttttctgacaatgccctttttcattcttattcttgaattttagatagctgggtataaatcctttgaagacactgaattctattctgaattgtattgttgttattgaaaggttcttcttcttcctcctcctcctgctcttcctcctcctcctgctcttcctccttctcttaggtaatatctttgtctttgtttcttctttagatattctctttgtctttgatgttctgtgtttcaccaaggatgcactgtgtaatggctctagttgtgagtttctttttatttaccctatttaggattcttgactttaatcaaatcaattaaagtgtacttttctcccattcttttaatattctctatgtggaattcttatgagacatagattaaacattacttctatgtctctttttaacatatctatatacctctctgtgaatatgcacacacatacacacatatataatatatatatttgtatatgaatattacatatattttgtgtatatattatagataaaagtatatatacatgtgtatttatatgcatattgcctgtgtatataaaattaatcatatgtaagtttaatttctatataaattatatataactttaatttatagttaatttaattatataaagattacatatatatatttgttgtgttttgtttttacttgcagtgccgagaattgaggtaatcatgttgctcagttcatggcacactattgttatcagtgggtgtactatttctcccttggttgtttgtttaatcattcctctttattctcatttcccacttatattttccttctcccataggaatctaatgtatttgttagaataagcaacagcacagtaccacagttgtataaattaaaatatatacccactaaagaacattatgtatttttaaagtacctatttctcactttctatattcagcattctgttttaaagatctatatatgttgctgtatatttatctagttcactgcttctaactgctgcatcttaatatataatgtgctgtcattgcatttccctgattcactcttcagtgctggaaactcagggaacttccaacttcctgctgtgcaaacaatgatcaaataaacattcttttacatgggttttatagacccttttgagaatttctctgggatgtattcctaggaattagattgattggtcattggatagacatatttgagccttatcctcttatattttgcatcttttgctgaatttgggatagtttcattaaattgatcttccagtttgtattttatatgttttaaattttctgtatattatgatgttttgacatcttaaaaaaccctttcttgctgtaaagagaccgcccttcctggctctagccaattcttagagatagcaaaggactcagttaggagcgtactttagatttgcaaattaaccaagttgtgtatcttctgtgtggcctgtacacccccagggaaaaatatgcttgtgtcttaatcatcccagggccatgtaccaggcaattagggactatctctatagtttagagcctgcagttattattcaaactaaccaattctaagaagtttatcctgccctccctcacgcttcctgtcccacggaagctccaataaaattctagttttggttttcctcttacttctgtcttctgccacctgaccaaaacctggtgattccccggtaactctgtatggcatgtggtacccccctctctagaacctgtgaaagtaataataaactttgttttcttgtggctttcctgtgtcccctgtgctgcacctgattaaccatcacctaaaagaactcagaatacgattcatacattttctcttcatctgcctctaatatgatatttttaaaatgtaaatgattagaagctctatttgaggataatagattgagaaaatgattgagcagaaaaagtaaatcaaatgagaatactaagacccttcaaaaaagatatggcagaaattcttcatgtgttttacaattttagaatgtaaactcataatttgttttgagttcatttgaaagaatcacatttgtaccagtcatgagttgatcagaaaaacggatcgtcatgaatgaaatagaatagtggatttaattagaccttgtacaattggggaactggttaagaagtccatgtcaggctgttgctttttcatgtggtatttactggacctggggtcactgtagataagctggaaggcaatcaggaatgagagttggatttgaaataggaaagggcaaggacaaactggaacccacaaggtcagacgggaaccccagaagacaaaatggagcccaccaggacaaactggaatttgactctgtctctcatgatctctaacttcaataatgttagtgacctgcagagaagtttgaacccttcatcctgaagttgcacatacacttggcccaggactgaaggaagtcaaagaaggaaatccactggaagctggagaactgtgggtctaggtgcttctcagtgtcaataaggtgggttaatagattagtgacaacatgtgcaaattgccaatgcctggtgtcatatattgagtttcagagtataaaatggtggcttcttcatttgtgcccttcagttcccagaccaatgtgctttatggcctactccaaattgagaaacacacaaagaaataaattctgagaatgtaattccagtttagctaggttgacatagtataaaaccatattacactagtttagttgaaggtatgtatctacggatatattttgtgtttatttcttttaccacccttgaagtatctccagctttggattaattttaatgtaaatttttcattttggagctttctagaccaatagccaaacttaaaatgagttacttgacagtggttctgggttctcaaggaagagtctctatttcgccattctgaacagaggctgagaagacaacttacccagttatttccctatacctatgggcatattagttcacacttacgctgttatttagagtggagtttctctaggttctagactctggtggtctctgttccaactccctataggagtagggacagacgaccttatctcctgcctcacagtggatattaagacatcagcctctagattacctaagacagcccttccccagagtagacaaagagtcagatctgggctttactgctgtgagtttcagttctctattattctctgtcccctgaagagctatttattttccttctagttcagaaatgcattaaaaattaaaaaaaaaaaatctagatttttcagatgtttttagttgacattttcaggctaactactctgccatgttacctgaacagggagtccattgcatttgcaaccaagaacttaaatgcagagacctcttttacaaggatagggtgctttagcaaattcagatttacaggaaagaaaattacaaatatacaaaacagatcaattagagggatgaatttgcataacaaaaggactcgccataggactagttaaaatagctaggatctaacagtgaatttagagcatctaggaaaatgtgcattgtataaatctatcaggcctgtagttaaagaaatgcggggatgaatccttttgtaaagcagaaagtcctttttgtaatgtgaatgagtactctctaatttacaagtctgtaagtttgagaagtttgagtctttgtgtatctggcttctcaaataatagagatccagaataagttatttatacagagagttcaggtttaactctcctgagtatgatttttctatgttaatataaaataatcaaaacaatctgcatatttaaagaatggaatcatgaggtccttcagacgtttaatatgtgcatttctacataatttcccatgggtcttgttactggaaatatgttgaagacaaatgtttccacaaaatgaccgatttcttttgatagatctatttaagcacacagtaaaaaacatcttgaccagaaacataattgctaattcactgtgttggacattagctattgagttattaaccagttatctgagggcctaccatgtgctgatcagagagtcagagttccttagatatcaggtacccaaactcttcattttccagatgaagaaactagtgatgtcaaatgacttgataaacagtttcatggctactcagaggactgcatgaaacttccagcatattatactgctttctttaatagagtgaaagagtccactaaattaaagaggttgtcaactccatggatgagaaatttatgttaaggaaccatgactcaccccgaagggtgccagactgagtctgtggcccagtgcaaagggcacagagacatgccatcagacaggcttgtgcctgcatgtcttgcattgacgttgggcaatttattaacttctctgaactgcagtttccccatatgcaaagcagaaaattaatactcatcctgccatcctgaaaatgtattgttagaaaagaacattattatatgggagatatactttactgtataaactccaaggtactttaaaaatgtcatttgttatgattattgccatagctactctagagaatgcatatatcaaaagatctatgaactttcacaaatatttttgcagaataatcaaggaacaagttgttaacctttttctcagaagcaataaacaagaaaaatctagactagatgtttatacaaaaagttatttacaattcagagctgtgtccaatgtcatttgttatcattattcttatatgagtgaattaaatattttttaaaaaattaatacatggaaagcaatcagaagaatgatttgcacacaacaaaatgtatatgaacattggttattgttaattatatcctcatacttttctattcctcctgcaattgtgcaagccaaactctctcaactctgaattttattttctattgtttgaaatgacaaagatcatgggtagctgataattcaagcattgtttttgctcaatgggaagactaagatgttgctttagggagtaaaagtatggggagacattgtaacaacagctatagtgtcaaaggacagtgtgtttttaaatgtatgtatacattatacatttattcccacttagcttctgttataaaagtcctgagacatcttctgggctttgatctgtttatggatccagatggcagagaggtgatgagaccacaggttagagagaaaatttagtcacaagattggaaattataagccttttactgcttaattattcccttcctgaatttcaggatatggtcacctatgaaggttattttacttcaatcaatccttggatgaagaagacaataaccatagctgtacaaaagaataatgagatttaagtattgcaccgatttttacctacattctctaattgctcattacctaaggcagctcagaaatgacgaactggctcctttttcatggtcaggacagctgcttttatatgttacatacttgtttaatatgaacttcaatggtttttagaagaaggaataattagaacaggtacagccaggggatttttataactcctttaatgaatactaaatagtattttatctttaaaagggaccatggctgcccttaactgcaaccaagttcattaataaaaagttttcatgcagcagacacaaaacaatataaagaaaccagagaaaaatctaaactgagagctgtagttactatctgtgctaagtgaatcaagcctacttgcaaagatgcataattattttttaataaaaaagaaataaaagattttgctggcttaaccaacgataggtaatgatactaaaaatgacatgagagtaggatgctgtatactgattccagctgcttctctttcgagttgggattatctgaattggaaaagaaaatccccatttccccagcaaggtacagattttacaaaacagagatccatccttgacatggtaaatatctaatgaaaccacctcttctttccatttttttcccaccctgagccacatgctgtatattaaataaaggactcaactttgttcgtactggagaagttgtctgggctgctgcaggatggaggtttacctgaggttacctgtatgaagggtgaattgctcacgctttagagcactgttatctttctccccatgtactccttcaacagcacaatctacagtgaagtacttgtcagggtaagcggtgaggaaagtgagagcaggttgatcaataaaacatagactggaggaagcctcttccacaggaaactaacaatgcataagaagcatattcttaacaatgtttggcaggaaactcagcagcatgaaatgtacttaatgtttaacagaagttctggaagaaggcagctttacacgtgacgtaaagaagattgactgaaggcatgctggggtctctatggaaagagatttggatgtgaatagacctgggcttgagccctggctccaccatgttctcaatgtgggaatgtgtgtgagttcctgctcctccccttcctctgctgtaaaatgggaatggtaacacctgccttaccagactataagcaaacagtgatctgagatgtgtgaaagctttgtcaactctaaagcactattaaaatgcttcaggaaagtagagggaatttatcctggtcacctgccttgggaacagtcacgaaaccataatgtgttcccagtcctgacactggcttccctctggctcaaaaactgggtcttgcaatgactggctttcttctgattttcaaggttgagtgactggcagtctgcctgggcacacgtcaaagagcaccaccacatcaactgcatggctgcagtccctgtgcaggcagcttcctttgctccccagcaagtgcaggggctggcagaggctgcttcagccttgtattgtagggggaaataggtgccacatgctgttatgaccatggtgatggtgggggcgactggtgcttctacataccctggttctaagctccttttctggatctttgtagttacacatgggagtcaacagcccactgccttccctttatcctctatctaccccattgccttcttccagcttccccccaacccccacccccgtctaatgaaaaagaagttaaattcctatcttagcatcaaatccagctgtagttttttctcccaactaagcacatgcagtacggtacctcctcctgtaccatatacctcctccagtaagatactcctgatctctttctcctcctctaggctcactttaaggtccttgttgtatgtgaccctatgtataccctgaatgtggttcttattgaactgtactataactgttaacttgctttcaattagaatgcgaactcttcaaaggaaattcttactcaccagttgtctctccatcatctagcatagtgcttggcatacagtaagtagatgtaaatgattatcgaactgaattgatcagaccctaccactcccattgatttaaaattatacatatgcaaagaagggtcattttgagaccacagtgcaatcaagatgaacatgtctctaacttctgacttctctctttctgaatccgtctaccctagctcacccatctgtctctgcaagaagggccaagaagagcacagactcagtcaaacaaagatggaacaaaattggtcacaacttgaactattccttctttattttccatttctgttttgaccctttaaaaggaatttcaaaattttactttcttctggtgctactaacgtaaaatgcctaataatctctacatggatacacgatttgaataattatacacttgatggggttataaggaaagtttggaaatcatcttacaccttctagacatattccaagtcaaattgattaaagaaattagttctttctccttagttctaaatcatatgccaggaattccaggtttgtggatttgtcatttaattgcatattattgataaatagtattaaagacctttcctgaggactcactgttctgagtggtttctatagctctgtgacagatgttaccagttggccagtaaaatccattccaatttcctctctcttgcttgttttctcctgcagagcctggaaaaagctaagacacactttcccagtctcctgcaagttggacggtggctgtgtgacatggtctggccaatgaggtgtaaacctgagtctgctggaaagatactggaagaacttttgatatcctgataaaaggaacacacatctctatcattgctccctttccccttcctccatctgggaatgcagatgtgatgacagaagctgccatagccactctgcagtcatgaggcaaaaaacacaaaagcatgaggacaaagtgccatcatgctaaggagagcacagcaaaaagacagaaaggctctggtcctaaatggcacagctaacaagtgcccatttccatgcctcttgccaaccaacacaattcatgtccttatgatttcaatccctggtggtcaggttttggtcacttgaagctaaaagcattcctaactgattcaaaccccaaataaaaacattgccctaatgatgaaacagaaattggttactttggcctcaattaaaaaatgaaatgtagctaatctttaacaaattcaatcctaaatagttctctttatgcctactgtcaggcaggcccttcttctgtggctggatctgatttcctaaagccttaatttctaactcaacatagcaaagaggtggagggaagccatcgtgcccaaaccctcatgggggtcatgacttacagttgactgaggatggcctccatttatcacatagtctattgcaacttgaggttcctttaacaaatactaggttataacatttaaagctgatatcacagcttctgttacaagaatattattgtactagtttcctaaggttgttgtataaattaccataaactgggtggcttgaaacagaaatttattctcttatagttctgggggccagaattctgaaatcagtgtgtcagcagggcattctccctctgaaggctcaaggggagaatccttccttgcttctttgagcttctggtggctccaggtgttccttggcttgtggcagcatcacgccaatcttcgtcttgtctttacatggccttctctgcttcctcttctcttttgtctgtcttcttttcttataaaaacacttgtttgacttagggcctatcctgttaatccaagatgatctgatcttggatcctaaatgaattagatttataaacactccttttccaaataaggtcacattcacaggttctacgtggacatatcttttggaatgccaccattcaatctactacaactctagaaaatttattccactttccttatttatttttgttgggtctcatgaactttgatttttttaagctgtgtgaggaaacatttatggcaatttaagttttgtgttgcatcagaatttaaggttgtttcaggaaacacgtgttttatttcacattttaaagtaaagaattatttctctgattacattttagtctttatttctcatgttaaagtaaaaaataggtgacttcagatcagtaagtatatcatggtagtgatattaaagagtatttactaggcttagtataactcaggcaaaacatttcttgcaaattattcaccataatctttgacataggctggattattagttttaaggcatgaattactttctacccaggtcaatggtttttaaccctgttacacattatagtcacctggtgaacctttaaaaatgcatgcccaggacccatttcaaccaatgaatgcaaatatgtggggatgagcttgtgcataaaagtctcctaagttattcttatgtatagtgaggattaaaaactgaccttgactcttattagcagttgccttattcaacaccatttatttattcaatcaagtaatcattatgcacttttaagtgtgtaagtagttgcagtacatataaggacatataagaaatgcaggtttataatttagtagtcatggtgtataatattttgtgtaatgtgccatttatactccagggtggtagagccaaatgcttatagagaccttctctgctggtcactcttaaaaattcaaatcaatttatagaagtaacttgtatcacaaaaaattagccaggcatggtgaagcatgcctgtaatcccagctactcaggaggctgaggcaggagaatcacttgaacccaggaggcagaggttgcagtgagccaagatcgcaccactgcactccagcctgggtgacagagtgagactccatctcaaaaaaaaaaaaagtaacttgtatcattattgctttaactcctctgcactcaggtgcgtgtgtgaacacacacacacattgctggtaataatcagagcaaaataagactcctatggttgactatcttcagattacaccctttacaaggtcaggagccttttaattattttagatcccccttccgcagagtagaaaccaatatatgcttgtaaaaactcacgactggtagtgatccctattagtagaaaaagcttgagcagtaaagttgcctgtgccctggagaagtgctgaggactagaaattcctctagcttccagctatttgggaagacccttgggtgttgagccaacattggcaggtgcgaaagggaatgacactggggctgaggagaggatctggcagccaattagcagcgcttgttagagctcaccccagactgctgtgtgactgctcattcagacattcatagacacccctgtcacaaataagccacccagagctctgtagtcgtacaaagcagcaataggagtggagaagaaccatgtttgtcaggaaggccctgcatgcaagagagcggcagggcagagagcagagtagagcttggaggctatagttgtaataagctttcaggaaaagagaactgagcaccttaattattttatttttttttttgacatggtcttggtctgtcacccaggctggagtgcaatggcacaatcactgctcatttgcagcctgatctcctgggcttaagcaatccttccacctcagcctcctgagtagctgggaccataggcgtgtgcaaccatgctcagctagtttttgcattttttgtagagacggggtttcgccatgttgcccaggctggtctcaaactcatggactcaagcaatccacctgccttggcctcccaaagtgctgggattacaggcatgagccactgcacctgacaagcaatttaatccgaggagtcatggagtcttatacatgtgaagtcttgttgatgaaagataggaagatggagaggagctggaggagaacatgatattaagccaagtatttaaaaactactgatgagctaggaatcaagctgagtgcattcattcatatgttaatcaaatactttttgaacatcttctatgtgtttcaggtgttgacagtgcagaggtgagcacgtgttctccagggtgaaggacactggaggagatttagggttataaaaacaaacagataacaaatgcacatatattcagagtaacatgatagaaatagatggtcaggagataccacctcagtttgggcgatgaggaaggccttgacccaaggaggtgacatgatgtgagctgagatgatgtggaaggtgttggggcttagaaaacaacaccccaaaatgaaggcctcagaagcagcctcagaagcaaaagtttttctctgaccttctcctgccctcctgtttctcagtcccattctctcctgaggctagctatagaaactaggatccctcttccccagggtgggtcatagaaaccagaccccttcttccccaaagccagccataaaatctaaaaatattactctaactttccctccacctttctatgtgaaaactggccacagagaaattatctgacttaccttgtttgactgtaggtcgtaatacccccattccagagagggtcttgcccaacacagagaaggaaggaatgcatgctcaggggggccaagaagaatctagacagacaggccttcctggctttcttcactcagtctattagcattagatcagaccctttttttggtccaataatatttcggcacagctgtccatactttgttgaaacgaagtgtaaaaatggacaatctccccagtatttttgggtcttcatcctgaaggctcccatgtttacatgctaaataaatttgtatgccttttctcttagtaatctgcttgaatgtgaattgatttttcagcaaacctttagagggccaagggcaactttcttcttggccccaacaaaggagaaggacggagatgcatgtaaagcggtccaggcagagggaagagcaactgtaatggccctgaggcaggaatatacttggagtttgcaaagaatcagatgatatccaggctagaatcagagtaagggcatgtctggaaaaagtggaaaaggcagcaggggttaatgataagcacgtggccatggctgggcttcgggaagggtgaggcttcaggtctttgtggtttggtctgaaagcgactgaggttccactgggtgagctgctcagggcacatcctgatgcagacagcctgttggctctgacagcagctctcccatcctcccagctgcaatgactgccgagttggctttgctttgagtattccaatcacacagggcctgcacctctctgcattccctgggggtgattttgatagtttctctgtgtgcacagtgattttgaggcaggagatacatgagcgactgcagcagcataagaagtcagtggtgtcaatgcctgacaactaccatgactgaaaaagttagattcctgaagtgacttcatttatattgccatatcctgacagaatctgaggccactcttggtatatgaacacagtatcatcttatatatatggaaataaaaaagaatgggaggtttttttttttcttaagcaaaaggaaaatattaactcaagacccaaactgttttattcatttgtggactcccacaataccttccttacacagttatttcactgattctagaacacacacttttcctcatttaccatctgtgaaatgataatgcatcttacaatccacagtgcctcacaattgccatcacatggttgtcatagcccatacccacatgcttggtcatagctgttcatgtgttgagtataattggcatttaaactgtgttcaaaatgattacattataatttggcatcagtacttggaaagatacaaatacagtagggagaggataatttgatatttgtgaagcaaataacttcactggagaagagactgcaatgacatatttcctttaaaagcagtaaccatgtgcattgtgggtctgaaggaaggaagatatccacaaatgcatgaggccttattatgctttgttactgcaatatatgaaaaagattacatgttacatgccaaggaactcaacaaaggcaggagtaattgacaaagccctctatatgaaggaaatgttcaatctgtgtgaggctgtgatgggtttatgtgttggacagaatcaccataaggctctgtgtcacagattaattggcagcacttgtttttcttttgtaggaatgcataacataatgatgcatcttataatagatggtatttctaggttccatgaaatagagtggaacaaagtagatgtttttgtcgttagactagggctatgcaaatactagacctcacttatcccatcacgttcaaaatgtctctgcagtttatttacatattaccaaagagctgtccacttgaaaacttatagtcagcattgtgtctcaagccaaggtaaaccaaactaaacattcttatggcaacatggccaggcgctgtggctcacgtctgtaatcccagcactttgggaggccgtggtgggcagatcacgaggtcaggagttcgagaccagcctggccaaaatagtgaaaccccatcttgactaaaaatacagaaaactagctgggtgtggtggcgggtccctgtaatcctagctactcgggaggctgaggcttgaacctgggaggcagaggttgcagtgagccgagatagcgctgctgcacaccagctggggcgacagagctctgtctcaaaaaaaaaaaaaattcttacagaaacttgatactcttggttggtgaactgaattttatcaaaagcatctatggcacacaggcagatgattgtagaatacatggccttaatgaaaaataagctaactgcttaggcgattatttcaaattcagtttaaggaagtcactgtgttttagcgtctgattttgaacatcaggactaaagaccctgaggcttttttcctttaaggtactatcaggtcagtgtgaaaaagctgtttgccaggggagccagttggaaatgaatgaaataatttacattcctgctgtgggcaagttgtcaatcattatgtgtgaagcctgtaccatcatttttctcctatatctacacaaggatgctgtcttaaggatgtagtcaagtgccgtgacaaatagcaggtcaatagctgaggacacgttgcctggtgtgtggtggtagagaaagggcacacctctattccccaaactccaggccggctgcttgatgtaatagcaggttgtaaagtgaaaaagcttctgcatgaaaggatagcctttacatggggtacagagcgcagaaacgttttttggccacacattggtttttctcagccatggatcataatgattatcagtagaatcatttgttttaaatgcagagaagagctgaaatgcttctatgtatcattgcttctggagatttctagaaatgtgtgctaggtagttcaatttaccatgtccaaatggaactcttgatttctccctccaaattttccctaacaaatattcccaatctcaagaaacctcaggccaaaaacatttccaccgatccttaattcctttgatttatctacaatcaatatcacattcatcatctctattttccttgtaaatcctgactcagatattctcaccttcttcaccacaccactttagtacaaggcaccaccatctcttgccccgactactaggtgaatgcctcagtaggttttcaatgacctccatccccattcccacagcagccaaagtgagcctttcaagcataaaccaaaccatatctctctcctgtttaacacccctctgatgctcatgctcacatttagattactatgcaacccctctccacagctcacaatacctgatcctgggccaccactgtgacatcttttctatcagccttttccctggctcatgctactacagccacactggcttccttgctggtcctcaaacaggcacggtcctgccgcaggggatctgcacttgccgctccctcagcctggagtgctgatctctgcatggcttcttcccacacttggttcagatctctgcctaaatgaaacctccttaaagaagtctttcctgatcaccctcctgaagatctggtcactgtctatcctcttaccctgctctatgtttccttatagtatgtgccactagctgatatcatattacagacttatctgttacctgcttattgtctttgtccagctctagaatgtaagttccataagagcaggagctctgttggttttgtttccaatgcatttctagagactagaacagtgcttggcatatagtaggtgttcagtaaatattttcattcaatataaatactacatatacttcttcatatgtcgtcttcccagttggacactttctaggcatactgggccctcacaaagatatatagagtgtggactacctttcaactgaagcattttaccggacatgccaactgatggcagcacccagggatggcaatgagatggtgtgtgcatcacccaagtggccctccacagtcaagtaggtcgctgaagtctgtctctgatgactttgcctcccacgtcttcctctgtgtctttctttcccattcctcccctggcagcaattcattcagtgggtatttttaagcacctgctttgtaaagggcattgtgtgaacatacagctgagccctccgaagtcaggtcttcaaggagtttggtgtctggtggagaggcgcgatgaacccacacaaatacaagggctggtaaaaggtgaagtgtcttgccccagtggaataaggaactagaaactgaaattggctcatctgactctgagtccagcctctcatccactctgctgccttgcagcccacccaagcctgccttccctctggcgctcctctgcagtttgtttgtttgtttgtttgtttatttatttattattatactttaagttttagggtatatgtgcacaatgcgcaggttagttacatatgtatacatgtgccatgctggtgcgctgcacccactaactcgtcctctgcagttttaatctttgttctaaatcctccttttccccttctctatattcaaagcaccaaatcctgcccttctaggtgaagttatacatcagctgatgatcagatcagactagttcacagtaagtgagaatgactcatagatttagttctctcaggtggcgtttgtattgtagtttgtctctgctgcagccagtcacaaggagatacatgtgtgggagtatctgtttctctatttttggggggactgcgggaaaaaggatgccacctggggtctgcttatttactgtaagtctttctaccttaccctgcctcttgggcttccataatgaagtaggtctggccatgggtctttctccttccttagtacaatttctaaagggaaggcaatattccatttttggcatttgggaggtggtgaaacaggcaccctctctgttctctctcactctttctctctctctatgtgcgtgtgcgtgtgtgtgtgtgtgtgtgtgtatagtggtactacagggtcatttataccagcacgcctcataagttgcacccctgttcgtcttgtgcaccatgtgccctccagtggctgccacgaagaagaaatggaacttcctaagtcagccatcctgacagacactgttggaaactttctctgcaaggctgagaacatgagggaaagactgcggatgttcattctgttgttaaacgtatctctgttgcaagaccagcctagtgtaccgcctttcatgacacaatacatctgtgaatataaaataacaggaactggtggcttttctcatcaaaatccaaccagttctcttcagacacttcttaacctgtaaaatgggaatggcaacagtgtgcatctcatagggttcaggtgaggggaaatatatcaggatatatgatgtatatatgacatatatgtcagacttagaacactctcacacaaaagtgtctttaggtcaatcaacaggtatttatttgccacctccggtgtgctagaaactgttctaggagctggggatacaggagtcaacaaaataatctatgccctgatggggctgattgtggttaataatcatgatagcaaaggcatagccaggatccaaatccccgcagtctagctccgagtccccagtctcctccatgactccatagcacctcttgttcactgagcaagagaatgcgaataatacacttgagatgacgttgtgagttgagagcctggacctcagggataaagacctgtacttggcagccatctactttgagtctgctagctgaaacctgtccaagaacataacactggggaaaggaggtttgagaaaaaattcttgagcaagattgacaattaacgaaggggaagataaaggaagagttactaaaacaaattcccattattgttactactattattccctgtgctcatctagaggagtcaagtaacctaaggaatcaaattcaatgaaaaaatattggttgcacacccactctgagcgaagagtggatgtgcaacaaatatttgagcaaggcacgaaaatgatttttcattagacagatactttgcaatttaattttctaaaatagctgagtttgatggtcaatgagttcaataaacaattttccagctttttatatatctagcaattccatgatcacacagtgtgtttatcatctatcattctccaattactgaatattggttggggttcctgtcccccagttttccatacatttaggcctccttgcatggtaccctatccaggtcatttttttccccccggtgagcccccattgatcatcttagattttctgagatggttttgatttcacatattttgagtgggggcttacaaacaataataagatcatccataattctaaaatctctcttcttttctctaattaaaacctttgtgggccaggcacattgactcatgcctgtaatcccagcactttgggatgcctacataggaggatcacttgagcccaggagttcacaacaagcctaggtaacataaggaaacaccgtctctacaaataataaaaataaattagtcaggtgtggtggtgtgcgcctagtcccagctacttgggaggctgagaagggagcactgcctgagcctggaaggttgaggatgcagtgaaacttgattgcaccactgcactctagcctgggtgacaagtgagaccctgtctcgaaacaacaacaacaaaacaaaacaaaacaaaataaaacaaaaaaacccataaaacaccaaaataaaacaacccccccaaaatctctggggtgcactgattgcagtaatggtcccatttcttcacccttccctactctcaagctatttaccgtgtgattttgcagttgctcctattgagaggtgaactatatcctcccctcccaagctgattttgagttttccatatagcttcctttggccaagtgttggcagatgtgatgtaagtagaggtgtaaaaaagcgcttgctcatttttgtttgtttgtttctttctttgttatgaagacatgtctgcgatagcatactagagagtggggcacagggagtcccagctgtttcagctgagaccaccccaggtcagtcaactctcatatgccagaagactagagccaactgccagatgtgagggagccagatgagatcagaagaaatttgcagccaagcccagcctaaatcgctgacccacaaactgtaagctcagctaaacaaatgtctatcgctttaagccacttcattttcagacagcttgttccatagcattgttgaggcaatggataactgataatgcttcccataaatcttaggaacttggaagctgcccctccatttgccctcctttaagcaaaaaattgaatgctatttgcaaagcattgtataaaatgctttattagattatcttattgaatcctgacaacaatatctagcagacagatataatgctattatccaaatttcagaggcaaggaaattgaagcttagagaagtttaagtgacttgaccaaagtgcttttagaaaagcagagattctacaaccagtcttctaaatcttggaagactgcttttagccacggctgcctgccatttactctttggattctccattctacctgttctgctgcctacttctaccacctaattaggagaagaccttgtgttcccatttgggatatagatacccactttcatactgggtttacccctaatatttctctccataccactcatgtagatggttgtcttccgcattaatctggaaattttttgagggtaaagactaaaatacttatatttttatccccacaactctatgcagtatttttttaaaaaagatcatagtcatgttttaaggtagctattccataaaacatataaaaaggtaaaaaatactctcctagagaatatatgcatatttaaaaggacactgttattcaaattaatctaatttgtggaatacacagtagagggttttccccattttgttaaatagttttagttatatgttatttgaatgtagtgtttgcctgaatatctacaaaaataaaactctcttgactcatttatagattaattccagaagcagggattaatacaaaactggcagtgaataatttctgttttgcagttagtttctgcatttaagaaattgctttagggttcagtaacttgccctggacttcaggtatgctgccaccagatggcagcagggtgccaggcataaggcttgtaagcaaagaatttgtgtgctttctgaggctcaaggtaatagctctttccttaagttcaaaaagattttcagaccactgatttccaatttagcataatacatttctttacaaaaataggtaaactaaaactctaagccaccctaagacatctttagaacagatataaatcccaagctataaaatcacctaactcattattacttctcttctctagcatctaattatttctgtaatggcttatacaccatgatggcttatacgaatcttatacacctacctcagtgatagtgttaaccattataatttactttgaatctttatgatcaatctctgccatggcaccgtgtatgttagttttcaaaattctcaatagtttttctccaggtaaaaaaaatctatctggctttcctttcatctgtcttaagagagcagaggtttatcttttcagtattatctgagatcttctcttaagaccaaaagtatttctccactacagtggcatgaacagtgtttatttgcatttcgtgtatgtatttgtgaatatggagtacttttgcttttgtattttctatactatataataatctactagaatatttcccctctcaaagctcttggaagcacagaggcagtttaccatactttaacagaaatatagctggattaaaattttttttttttagcaacaggctctgccctaaatatctcaagaaaatactttaaagaacaaaaatcttcatgccaaattagcaagatacaggaaaaaaggtaagtgggcaaaatacagggaaaaaaagctaattcaccctgacagttgttacacaaagctgagagagtctttccctctcacatttacaaagtccaggagcggaaagactttcagcaggagtaagccatgagggtttggacaaggctggtaggggaaaatgttatctcctgggcatactgggaagctgagagtccagggcaggtgaatggggttggagatgggaatgagggaggacagcatctgagcagtaaatcctggaactagagttagcatatcaagcagggctatctatgcacccaaggtaagttctggctgggagaagcagatggcaactaagctgtgaaaataggctccaagggaccagctcccagcgtaactctgggggagggatctggggaagtacaaaaaacatagagaggcaaaagacaaataaaataggaggagaagagaaagggatggatcatagaaagctcttatttgattttgagtctcacaggaaacccatgaagccagcagggcaggtattttttatcctctatttacaaatgagaaactgagtcccagagggggtaagtgactttttttaaggtcaacataccgaggggcggatataagattcaaagtcaagtgacctgattccaagctaaagatgaaagaagagagggcacatttgaaaccctgacacacacactgtatgtcctactctttgctttataaacagtaagtaaaattttcaaataatggaagcttagtcttttaagggtcaaacggaagcagctttagccactgttgaaaagcatttctgaaatgtattatatttgcccttgcctcctttgaaaactgactgtaatctactctcttcttgatacatgggttataattacaaaaatttactatatttatgaacttctaattcagtagataccctcaggttctatggaggcacatgtgttttttaaaaaattaattttttttgctgccccacctaatacattcatggctagaaatagctgtgtagcagaactggctgagtcagctccttcttccctcacagccagctcttccttcttaagtgtgtctgctgctggtccctatctactgcttctgatcaggtcattccgcttattaaaatcctttagtgactccctctaaccactggttgcagtagtttgcaaaacaggctgcacatgaaaatcacttgaggagcttttaagacctcctgatacccaggtgccaacacgaaagatttcaattcaattgttttagatatggggccctcacctacagggattaacataagtagcatgaactcttgcttctggccaagatggaataacgggggctagatttatctttccaatggacacaactaaaagtccagatgaatatattaaacaatggttttcaaggcaacgggcatgaggcattgaaggacagtgatccctgagagatggaaaacaaacaaaatgagttgcatttgcctgcaattgcccctgagagaatttctaggccatgcagcagaaaggaagaattcagaaggagtctgcaagactccttaaatagaaaagatgaagcagagaatccaggtagactagcgtggctagagtttgccaggcagagtattagagagcagggagttctgatcagtacatgcatgtgaggaaatggtataaaatcaaatgaaaaaccagctgaaaagatgagtaggaatagtctttaaagttcaaactggactggtaaaactgagatttgaaaactattcaaattgggaagccctgaaattcaaagagcattggtcaagtactcagaagggtattgccctcgtggtggggaagtattgtcaatagactaaacaatactctgccttgcctaaccttaaaagcaagacctgaaagatcaaagactattcaaagaattttcctgtatcccagagcaatacccaaaaatatctgtaggaataaaaaaaaaatccagcatccaacaaggtaaaattcataatgtctggcgtgtaataaaaattaccagacatgcaaaaaaacagcaaggagaaaaatcaataaaacccaaacctaaactgacacaggtgttacaattagaagacaaagatattaaaccagtaactgtaactgtattccatatgttccacaagttggaggaaacagcatgtttaatagagacagaaaatataagaaagacccaagtctggccgggtgcggtggctcatgcctgtaatcccagcactttgggaggccgaggcaggcggatcacaaggtcaggagatggagaccatcctggctaacacgctgaaaccccgtctctactaaaaatacaaaaaattagctgagtaaggtggtgggcacctgtagtcccagctacttggaaggctgaggcagaagaatggtgtgaacccaggaggtggagcttgcagtgagcagagattgcagagattgtgccactgcactccagcctgggcaacagagcgagactctgtcttaaaaaaaaagaaaaaaaaaagaaaaagaaagacccaagtctaacttgtgaagatgaaaactataatgtccgagataaaaaatacactgcatagtaacagtgacagattagctattctaagaagaaaagatgagtgaacttaaagacatagcaatagaaacaatccaaatgtgtcacagagagaaaaaagactgaaaaaaaatgaataggacattggtgaactgtagtacaactttaaatgacctaatactgatgtatttggggtttccaaatgagaggagaaataaggtgagtaatagaaaatattctgaggccagatatggtggcttacaactgtaatcccagcactttgggaggccaaggcaggtggatcacttgaggtcaggagttcaagaccagcctggccaacatggtgaaaccctatctccactaaaaatacaaaaattagccagatgtggtgtcgcatgcctgcagtcccagctacttgagaggctgaggcaggagaatcgcttgaacctgggaggcggaggttgcagtgagctgagattgtgccactgcactccagcctggatgagagaataagactctgtctcagaaaaacaaaaaaatttaagagataatgactaaaaaatttccaaagttgatgacaatgataagtctcatatttaagaagctcaaaaaacttcgcacatagaaaacatgcaaaaaatgataccaatgtgtgtaataatcaaattgctgtaaaccagtgaaaaagacaacaccttcagtgcagccagggggaaaaaaactgacccattatgtatagaggaacaacaaaatggcggcaggtttcttgttagaaataaagcagaagagaggctggtggagcaatatctttaaagtactgttcgttagaattctatacccagcaaaactatgtttcatgaatgaaggcaaaatgaagtatttttcagacatacaaaagctgtgaaaatttatcactagcagcctcacactatagaataatgtcaaagacagtccttcaggtagaaggaaaatgacaccagatggaactaagggtctacataaaggaatgaagagcttggttggcttcaagggtgtgtgacctgtatggttacacaaggtcctgcagatagaagggccttgtgctagctttaatgttttgatgttactggctaaaaatttttaataatttttgaacaaggggccctatattttcattttgcactggtagctggtcctgatgaagaatacttagtagtccatagaggtggaggcagaggctggaatgccgagcttggctctgaagatccaggccatatgttcaggcatggaatagggaagagatggaggtggcttcttcagaggaaatttggaatgttttaattttaatcacgagaagggtgaatgaacagatgtccactaaaataaaaattttaaggtagcaatttctgggtaattagaacacaattttcctttctgcacagagatagatcataaatggctataattagagagtttcagttttttctgaagttcatttgttgcggagtgttcaaaactgtctcttcaggccaaaatgccttgtttattgtgtgtgtgttttactatttctgatatcaatgctttaataatgcctgttctgtaatattggcccagaggtactgcaagagtgtaaattcactttacatgaaaaagaaaagctatattacttccaatgacattttagtgattaaatgcattttatttgtagtataattctatcccagtttaggtcaaagctccgaagttgagagtagtataataagtgtggacatgcaaaagatgctgaaaggtagtagaaataataatgtcagatctagcccatcaccaccctccagaacatatatgaaaggattagaaatcaatgttaagtgtgtatttatttgggagactgtccatcctaaatgaggacaaatgtcagggtgcttttcccaaaacttgggctggctgagggaagcttcaagagaatccctggaacagcttgaaatctggatgcagggggtggagttggtagagtccagaagctttacctgatatatgcctggaaaagtctaaagctcagaggtggtatctagctgtcctgaaggcttgtggggagccagctgtactgtatataggtataaatgcaatgcttaaatccacagataatttataaagttcactctacacttgaatactcacatccagtcatttagttgaagccttcggctttgattaaagttgttaatatttgaagtgctgactgatgtaacctccctggtatggaaatatgaatatttctcatttattatgtcccgtggtgaaagcataaccttttacttaaaataattggtttgaaaatggaattagaatattcatcctccccattcctcccctgcaatttgtgaatttagtaattattcttcttggttatgagcataagttaccatttacctttattcaatatgtacacacgcacacacacacacacacccacacactctcacagaatgcaaaaaaaaaattaggaaataaagttatcgcaactttagcaatgagagcggggtagacagaagtgtgagtttataatgctgatcatgaaataaaaacttcaaagcaagcctaaatctgatactcataggatgatagctctactgcatttaaagcaaataaagttacatttctcaagaattaatgcaaaattagaaagtttcctttgaaaatctcttagcacatctccaagtggttagctttcctgggaaagctggaaattaaatcaacaacattgaaagaaaaaaaacctcacagtcctaaattaaacagtcatgtaaatatagtttccaaagctattaggcaagaagcaaatgattttctaatcaatttactgttgcaaaaataatgccagattattttcatggggcatgtgaaataatttacatgggacacacgtggatattgctaccttagcaatcttatctagttctacccaaaggtatttaaaaaacaaccactgacgctgaagttatttgtaatcatatcagcagcctatctcctcatcctccattctcttcccctccaccagctgacttttgtatcaaaggcaggctacccttgcacttctcttttcacttaacatagaacaacagttactggagcaatctggttcccttaaaactagcgactcattacaatggttcaggatgtgaacttccctaaaaggctttgctctaaatcaaggtgactgtacattcccttttaggctagaaaacaacaaactatgcattcttagtataggattattcagcccatatattatatgagactacctcatatttgggtacctctctcattagttgggataaacaagtcttgaatttgagataattcaaaatctttgtaagccaaaggcatgcacacattttgcctttttctcattttaaaacccagtaacccaaaaccatcacatgaactacccaattctattgggcatacaaattttgttttctgatttccaagtctgaaggttcaggtcaatatttgtccgtaattaacatggacataattaatctgctgagttaaatgacatacaaatcctcaccaccaagagtgtgaacttgcccataaagttgtcacacagaaaattgaattcaatcagcttactttaaggaaaatatactgagttagtggtagacacagatggcatgcttcagaggattttggccttaaggtctaagagacagtgactatgttttcaaattttgacacaatgcttgtgacaggcacttctccctgtattgaagccagaaaactgttaagagccaacatgggtggaaaagaccagttttctttttttctttttctttttttttttttttttttgagacagagtcttgctcagtcacccaggctggagtgcagtggcgcgatctctgctcactgcaagctctgcctcctgggttcatgccattctcctgcctcagcctcccgagtagctgggactacaggtgcccgccaccacgcccggctaatttttttttttttgtatttttcatagaggcagggtttcaccatgttagccaggatggtctgatctcctgatgttgtgatccgcccgcctcgacctcccaaagtgctgggattaccggcgtgaaccaccacgcctgactagaaaagactaattttctgtctcaagtcaaggctgattggcctcatgggtggtggtggatcagtccctaagccccggcagtaaagccaggggccgtgatccccatagtcactgcagctgtctacaaggtctggctgcagtcactaaacaaggatctctaggccacaggtacccccggcactggggaaagtgagtgcccaagcttacatcttaaacactagttcaggcctttggattttgagagacatagagcctcacattgtaagtgatccttacttcagtgaaaacatataatagagtcctattgaaatccattctttacaatgggagattactgctaatgctagctaggtgagtgattcatgtgctacctattgtaagtattaattcttcattaggtagcagtgtgattcagaaaatgttacatagggatatttttcaagctattccattaactaattaactgggatgcaacttaagttggaagattgtttggttgatgtatggaaggtacccctttaaaaaatatctatgagtagccatgtgatgagtgtcaagttcttgacagagaattgaaatcttagcctgctgcgaccaaaaagcaatactgtttcagttagttccgttgccacacagactgaatgaaattaaccaaaggctttatgttagacaatgagtctcttctgaaataatgatagcttttgtgagggcataagaagcagaaagttaagaaagagttacttatggccatacaatcacattaatttgtctatttaatgtgacttttagattcaagaacaatttctatacgatgttctagaaaagacattattttttcagaaagacttttaaaagcaaggaattaattagttactaataataaccatcatttaaaataagcaatggcatgtaatgtgtagaaccgggacttttggcgagaaagtgacataaagagtagaacagagcacttttgaaccagcagaaacttatttgctttatctcttagttcataaatgccattttcctcaatcatttactataaaactaaaactattctttaaaaacctaagtgatttctcattgttactgttaaaaagaaatgtgtgctatgccaaatacaattcaaatgaatgaccattttatgttacattttcatcttattccttcatttatgctagaaaataacaaaagtaaaaatgcaatgagaaaagtatcaaagtcatgtatgcagattcagttgatctctttgggcttgactatttggcaacatatgttggccagtttttataggaaatctatgctaagtgtatgaataaaacagagacaacgtaagattagacactagcttcagaaaataaaattttgataatacagcagcctatttagtaagaataaaagcagtctcttggagtgtgggatttgtatatgtgattaagaaatagagacaaggggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaagaaatagagacaaggaaacatgatagagatagaaaactaaaaaaatgataatttaaatctttaacagtgaatatgagcaaagatcagaataggaacctatttattatcatatctatatcctataactgaaaaaatttcctaaaaaggagaacacaaaaatgcttggaagattttcttggataatgcaaaataccctgggagttctctctttacctcttagttcccccacatttaaacttcaaaagacaatgactctggagcttgagagagatcgatatttaaaacagaaggcatatctataaatccccattggatgtccaaacacttataaaaaaagaaaattaaatttcatttatcaagggttgaatagttaaggtgtcactaagagaccaacttacattaataagttcaacctcccagatttttttcaacaggtccatcgaagtgtagccattaattagaaaggctttggtgtagtcgcccagttcaatggaatccagccactcagctacagaggtgggatggtagccatcatgcccaatgggtctcatctgtaataaagaaaattacattaggattaaactgtatactttgtgtcccaacaacagaatgcagatttccccttgaaaatttatttgacatgaagaacagatctttctggagacggaaacaaggaaaaagaaaacactttctgatgtgttttcacaattctaaaacattaataattttcacgctgaataggttttcaaaatatacacagaaatttccaatttagctgctagattaactctatatttggaagagctaaacatgtcaaacttctgtcatagacattattggcattctggtgggtggaattaaaaatgatgtcagttgaatggcattaaattcgatgcgaaagtcaccaggaagtgcactttcaacatgtagatgataattctcatatgcacagcaccaaagcatgtgaaaatactgcatgacttaagcattcaaagggaatttgtgcttatgcaagacatgtattggaggtagtgcaaacacgctggagaaacatactgctgcggtgaaccagtaaaggagaggcctttgggtattttaagaccatgtgttctgcatcgactctacagtatgttagacatgaatagagaacttgctggcagacaggcatctattttttgtcagctatatacagatttttaaaaaataggagaacaaagaaatgtgacagcaacataatgtttctgagtttaaattggagtgtgaaagtaatttaagcaagaggaacttctgggtttaaaattttgtatggattattctggtcctttagcttttatttgaaattgtagctgaatctgtggttcttggttttcgaagtgactcacttctaaaacttgggctgctttgcatgccacgccgtatatctaatacttcagtttttcaggagagctggcacctcatcaacctgatgggggccttcggtaaaattcacgatggaaacagcaaggctgggcaaaacacaacatagattttcctctttctttgattcaaagagataaatattaatggaaatttatatgattctgatttgcgagcagagaaaagattagtctgggaatcagggattcagattttaatcttaaacatggtaagctttctatcactatgcatggttctcatttttgagattctccctactccttcattttaaagttactttttctcttttccagttgttccgctccccattctagtttccatttcaaagtttaaatgttctctgttttattttattttttttgaaatggagtcttgctctattgcccaggctggagtgcagtggtgtgatctcagctcactgcaacctccacctcctgggttcaagcaattctcattcctcagcctcccgagtagctggaactacaggtgagtgtcaccaagcctggctaatttttgtatgtgtctctactaagagacagagtttcaccatgttggccaggctggtctcaaactcctgacctcaagtgattcacctgccttggcttcctcccaaagtgctgggattacaggcatgagccactgctcctggcctaaatgttctctattttaaagttagagtacaatttattatttacattagagtctgaacttggtcagacttttgtacttcacttttacattgactgacccattttagctactcattaaatatttgttcatgtaacacttaactctgtgtttattatgtggtagctacaaatgtaaatgacaactcagcatttgcagaatgaaagtcagtggcattcacaaatccctggatgttatgtatgtataagatcagaggctaggacccaaaagggaggctcatagatattcggtagcttcatattctatagagaattacaaaaatattggggctgggtacattctccaggcctcgttaaaaggtggttgaactaactctgttaacctaaataatcactctggccccaggaatcttcctgactgccccagtgacatgaaataagaaagaaagggaagaaagtgagaaacactaaggttgaagttaactgcttagtagggaggtcttgccgttggcccatccataaagctgaccactccagcagcagatactcgggaaaagcttagggagtcttgatgactggatttgggtcaaagtcagttgtctcataccagtgaactgtgcaatggggttaccacaggttacccccaagcacttacacaacactcttttgaggaagcaattagtggccatctgacacacagagggtgttgatggtcggtggtggccaaagaatcagggaacccatgacaggactgcaaagaaaatctaggtaagtacaaagatgtttgcttgtccctccaatccccctttcttgtcccaatgccagaaaatttagaatcagaagagagaagtgccagtcccttaggggaagtctaaacttgggggggggggaggtggtgaggaaaataaaactggaggtttcaaataaattggaactgagccttcaacattttacatggttggaaagttattggaaatgtctgagatgatatttataaatagtaaagggagggtcagttgagcttggttgaatgattggaaaataaaaaaataaaataaaacagcaaccatcatatcaggattgcacggaatgcaggctgttcagtggtctgattactcctgtaaggcaagttctcctagaccaatcttaaagaggtgagagggagggaaatatttggtgggaggatgaaagacaagggcagggtagagagcacaactgaagagaccttggaaatgggtatgctgaggtgtacagggcagtatcatccgcccactcattcaataaatatttaatcaatgcctattctgatgaatgttgtggaaatggtagagaacaaaacagtcatagtctctccctcatggagattataactcttaattaaaatatgcaaacagatgaccaataaattatgaaggttctgcatacctgaagagaggaaaccattagagccaaatgcagttacaaaattaacttgacacatatttaatgatatgcagaatagttactgtgctgcacaataatttcttccaaagcaatgatcccatctgttcctttatttctgtccctactgccattaccctgtttaggttcttgttagtgcttacaaaaactaacacaatagccttctacatggtctcccacctttgatccagcttgtatcttgctactacattagtcttcctaaaagtcagacccttaagtgtacctttgtataaaagcctgtagtggctccttctcgaaaaaagtccaaatgtcctattccagcattcaaggccgattgagattagcctaatctcccactcctctgctattgtgtacccaataaatgtaactagacacgtgtatgtctaaacagtacattaaatcgctaggcattccctgaaaatgacctgtatatgacacagtcaatatctttgctaatataacttcccatgcttggaatgcttttgcccctgcttctggagtgatttcttcaggactggcttctcttcttgagctctgagatgcaaatttctaaccatttgtaggacatctcacataaatgtcctataggtgtcaccaacataagtcaaaaacaaatttaactcctttagttcaaaaacaggctctcttcctctttttttccatttcagttaagggcaactattactccactgcccaagcagaagcttgggagttatcttactttcctctttctgtttactatcatatctaattaggccaacatggtctatcaatttgatttctaagatgactctcaattcatttctcttcttccaaaatggactttggaatatgacattcccagcagtgctacgtatttgttgggtgatctttggcaagttactctttcagcctgtttcctcttttttagaataagcataataatacctattccaagtgttgttgtaaagattatatgaaatagggaataaaaattgcctagcacagtgatttgaatataatagctattcaattataactcttagttctcttttctccccattgccctaaattagacccatgcttattttgaaattgcataatattctgccattggctgctagtcttttcagcttccaatcaaagctctcctctctcatcccttcctatttcctctatttccttccttctttatcttgttttagaaatggtttgcatctgctaacatctttacccctctccccttcagccgacagttattttttagaaacatatctaacgaggtcactcaagtcgattgaactgtttattccaattcttcgttctcttactgtattagaattatgcccctgtgccctttgccaagggatcaacattatgtctcagtgtggctggagttacttcccagtctcatcaatgctggccaatagaatgcgtgaagtgtcagtgtggtggttagagacgaggtctctgtgctcctgtgttctactaatctttcagtgttcatatgctctctcataagaatagcaagtgctgagaagttgcataactcctggttctaggagaaagatgaagactcgtggagcaaacctaaatttaacccaaagcttggaatctaccctagctcgatggggctcaggaaagtccagatgaagttagctgaagcacagcagacccgtgagtaagaaaaaaatattttttgttgttgttgctgtgaactactgaaattttgattacagggaaaaactgaatagtcactccttgtttaaaaacccttggtgtttatccattatgcctgtggaatataaatcagaccttttagtttatgaatctattggcaaatgcatcttcatgagactgagaaagattagggatgctgaataagcaaacatcagtatccttcccaagctacctcactgtcatgcagaaactctgcatgccacatcttttttttttttttttttttttaagacagagtctcactctgtcacccgggcacccaggctggaatgcagtggtgcaatcttggctcactgcagcctccgcctcctaggttcaagcaatcctcccacctcggcttccctagtagctgggaccacaggtgtgcaccactacacccggctaattttcttttgtatttttagttgagaccagggtttcaccgtgttgcccaggctggtctcaaactcctgagctcaagcgatctgcctgcctcaacctcccaaagtgttgggattacaggcacaagccactgcccctgccctatatgctgcctctttattaaccctaaactaagtaattctttattgtatgagtttgatttttggggcataatccactgtacatgtaatatacctccacatcttcgctcatgccattccctctgctaggaatacagtttctactttttctcctaatgaaattctatctatccttttttttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaattctatctatccttaaaaggtcctgtttaaacgttacctcctgtgtgaatctttctctaatgttaccattattccaccgaaaaatcatatcttctgctatatttctgtagtattttccatagagttctattatagtattattaaagtctgctttcaataatagagaagtgagtatctgtcttcttcattggactgcctaccccttggtgaagaaatgaggtgttaatcatttttgaagtccctaaatcgtccagcagagcatctcacatatggcaagcatatgctaaatgtttgttaaattaagtgacttaatgaatacatgaagacaaaatgacaaattcatttcagtggcttggtatccatttgtgggagagatttgtattttgtactccatgttatgaaaactaaggttatctttttctgcctaacaataacattcataactatttaaaacctccatatatcaagaaccagttccagataggatattgtgttacagaatgcaatggactttgtttccatagcacagaagacttgattctattagccatgtagccatgggcaagtcacttcatctctctaagcttcagtggtgtcagctataaaatgaaggtattggaccaaggatctcaaagctgctttgtaattcctaaattttgcaattccatgactcgtaaattaattttaaattagtaacctatttgtttacccaggaaagaaaaaataagcccaaagacaaaactaaaattcatatatatatatatatatgataggacgtgtagactaaaggtcagatggcattcacatttctttcatgtatcttcagcagtacccacagggagcactgtgactgcattctcaaattagcaatgatgaaactttttttccagcgggaacatctggcaagacagggctaggaagtgacagctccatcggcctgccaggccagcagtgctgctaagcatgaacggaagtcaggctcactctataatctgagaggcagagtggtgagcaggcagcaggcattcattacagaggctcgcaacaaggcaatttgattcaattagttgaattccaaagtctggaaaaacctaagctgagacagaaattcgagatagcagtgaagctttagtcttgggaaaattgagatatattaacatattttttttttgccaaatgccttccttgttcttgttccacccaaatgactttcctccaggagttttttagagcatacttggcctcagagagagtatgctgttaacatcacaggtggtacagcaggcagagaaaccacaggacagtactctgtggagttctgggtttgagggggtcagctacggggcagctgaacaacccatgctctgagactgcttgatcgacttcaaccagagtaactcttattttatgcgttttatacaagtaagaggaagaaaggttttctcggctttaaaaagaaatgtttgaaaaccacgaatctagaagacttttgtaagattacatgaccactatgattttattttctcttaactttttagctttatttgaaatattatggatctgttatatatatgtggttatatatatatatacacacatatacatatatacacatcacacacacacacacacacacacacacacacacacacacacacacacatatatatagagagagagagcctgtcattccatcattctttctctttgcctgaagccagcattttctgtgcagataaggataatatcttatgagatgacggagccacaggatggaaggtatagcaggaggaaggcaataaaaacaggtaaaaaaaataaaaagagagagaaaggtgatatacattataatagctttgggattaaatgagaaaagtagttcttgatgggacaacttattaacctagaattatgatattggcatggtatttagaacaagaggataaggaaccctgaaaagccaataatggattagacaggcatttttatgtccaaaagtgttagaaaattgagaaaaagactacttgttgttcccttaaacttgtcctctcttcttccacataatggggttaaattgggttcatgcctgccggactagagacaagatacatcagctttttttctggttgctgctgtgaaaatatggttgagcctgtggaatgctaatgaaagtgttgcatgtaactttcaggtcacctctagctaaaagaagttcctcgacctagaattcctcttttttcttcatcttcctataagctggaacatcagtgactgcagttcagctttgactacacaggcaaaacaataccctggagtctgggaaatgcttctcagacctcaacgtgcttaggaatcatgcagagaatcttattagcagacgattctaattccgttatttggagggaggattggagattctgcatttctaaccagcttcctggtgatgctaatgctgtcagcccatgaaccacactttgagtagtagtgctttggaggatgacagaacaacaaatagaaggtcctcggtccttccacaattgcatagagcaaagccaccttgtaaacctgcactgctcatttcaagactattatatgagagaaattaatattcgattctttaaaccactatattatgaatgtctctatttcagtatcatagcctttccttgaatacaaacataactaaaaataaggcagtttcatgtagaacatttaaatgaagcctgtacttccatttgacattacattgtattatctcttgttttgtggggccgtaagttttcacatctgttatcgttaaagaagcttcatttcctttaactgtgtttgttggcatttctctgtcaatcacagcatcatccctttgtaacaactatgcaagggataagaggagaaaaatgcagggaaaccccaagtttctagcttggatatctgggcaaatggtggtgttaccaggtaaaagagaaaagaaaatagactgggatgacatgaataattttgagacatgagaaatttaagatgctatgctgtggaatggcactttaaatttggagaagtctggggagacacgcggccttgggcatcatcaaagtacaggtaagagtgttggcaactccacttattagctatctgacctcgagcaaatcactcatacttcctaagcatccattttctgattagtaatgtgaaagattaaaagaatatctatcgctgagcgttgccatatgtattcaatgaaactacacaaggagaatttagcacaatacttggcacacagaagcactcaataaatctttgttattttttttctgacagctgaaatcatgcacaggtaggactgcagaggtgactttgtagtgtgagaagagaagtggcctgagaatgaaccaacactttcaatgcataaggaacagataaaaataatactcaggagaccaaagaaggaatggtcaggacaagaaaagaaatgggggaaataagagtgtcaaggagagtgtggtcagcagtgaggggatgctgcagagacgtctaataaaatgatgaaggagaagggtttgtgggatcacaaataggtcatcggaaataggtcaccagacaccttattgagaagagcacagaagctgagctgccctaggttggggagtttgtatgggaagaaaagggggagatgagattttagaaagcacagaggaaaacacatggaaaggggtaaagaaatgaggactcagggttgagaagggtcagagtcataaaacagttaagttccagggtgcagtggagattgcaggggagggcttgccttttgctttgacactttgccctcctttcttgaaattacggatctgacaaggatggttggagctaacttcagggtgaatactctgtgttaaaacagtgcgagtgtttggaagctacatggtttagacttggtgagagctggatgcttgtacgtgaagtacctgtgaccttctggtgaaggtcctcacgtgggcaagagctgtcgcctgtgttgtcttcactcctcagatacaaacacagcaacctatcatttacatagacccaccagtgccgatatccctgatgtgccaggctcagctacttaaacttgcctaggaagctgccgtggaccgtggcttctcttttcccacctggatgtactttgtacactcagatttcctgcctgatatggcttttgtaatacagatagctgatatcgtcaggtacttccctctattctggctccttgttctagactcttctgctctgtcctgctgctacccaagtcttggactaacagcagtcctgaaaataaacgaggacaagcagtgctagcagacagtgtgctgccaagtccaaatgcaggtctatcaagtagtgtgaggatcaaatctacaggctgtgagacctgggcttagacatcactgtgctgtttcatcagtggctcttaaaaggctgattgaacataaaagagaaaggctgatcttctgaccacgaggccccagaaaaaagtctacctatcaccatctgagtgctatctacggcagtgcaactttgctgggagggacgtctccaaaatgctgagcactgttaatgataagaacatcacttaacaatgatgtgggactttaaagagcctcaagtgatttcacgcatgtcacctcagttgtaaagtgttttaggtgatctttaggaagacaccctttaaggagtctgagagcctgagtatcccatataattatattccttctgtgggaatggaaaggattaatatactgtgactgttgttggaaagcaaggagtgataaactctctgtgttgtgcatctgtagcaagggaggtatacatgtacaaatacgtctgctacttgcagctcctttgtttacaattagactctgttatggatacaatttctataaaagaataaagagaaacataaaccctcagaagtaagaaaactgtgtctgatgtcactacgaactcacagctacagaaagtggtaacccctctattatttttcccaccactgactgagccttactgatttggggttccttgagtgttcagatattgaagactcccagctgtaggcataaggcagaagcagtgaagaagtagtatctggatattacttgatactacatttttgggaaataaagggaaaggaaagtgctttggactagacactgtctctcaatgttctaggttttctatttcgtgaaaaagagaaatgaattaaggtctattccagagagggcctgaggtatccctaattttgaaaagtcttagatcatggagtaaaatagaagtgaagcaatggacagcaatgaaggactagatttaaaaatgttttcaagacacataggggatcagcttccaacagcacagaatagcctagaagcactagactggccctgtctctagtcatcagggataggggcacgccctctggacaaaggcactgggaagactacaagttaaaggagttaagttgccaatgcagccaagttctataaagcatccttgggaaaaaaggtcaaccgctacagcaacaactacaaaacaatctgtcttatttcaagccgtgtgtgagagctactagtcaggcactgctctttttagcttcatctgtgcccagggagattaactctatctgtagcagcacttgagaaatgctatctgccatgtaggatctgtgtgggatgcagatgaaaagaccagtagagccctaacacagtagacatataacatggtccttggggttgaattattttattgaatggttttgttgtacctctccctgaagctttgcgtaaaagaggtgtttttaaaaatttaataagaggaaatgtttttaccatcttttcatttctaaaattcttgttgaggtaatgttgaccctagagccttttgttaaacatcgttatttgttttgatatgtttccttgttgcaaagctttttttatgaagcaagagttcagattaaagatgaacagaggatttactgcaactagaataaggcgctgaacaatgttcactagcattcacatttccaagctctactagtgatgtgaactatatttagaaaaaagacacggggtctctttttttctctgacagtacatgttttctgtcattcatgcagctatttggtggttatatagtacactgctttgctcttcaaacagaaactttaaatgctactattaatcaggaatatcatttgcatacttttagtctcaactaaaataatttccccaaacttgagtcttcagaagataatgaatgccctgaatgtcaattctatttatttgatatttaaaaaccatgtcctttctcagagcctccaggcacatgcataataacataatccacagaagtacttcaagcagataaatgtaccacacaaccagaattagcagtacacaaatgaatgacttatgttctacctgggtagagcagtacaaaatatgtcattcacatggtggtcaaacaggagtatactcacgttcacttagggagttacaaaaatgaggacctaccatccattccattcatccatccatccatccatccatccatccatccatccatccatccatcccatccatccatccatccatccatccatccatccatccatccatccaaccatccatccgtccacccacttatttactcaacaaatactaacagtatgtttgctatattctaagcactgttctggatgtgtcagtgaacaaaacatatgaaggtgccagtccttgtggggtttaccttctaagtggggaagacagataataattaataagcataataaataaagtatatagtctgttagaaggtgataagtgctgtgaaaaaagagaaagtgcagtggggggatcggaagtactggagtgtgtgtatggtgtggcaggtgcagtattaaatagcgtggttaggggaagtttcattcagaggagaagatttggacaaagatttaaagacagtggattggctgggcacagtgactcatgtctgtaatcccagaactttgggaggccgaggagggcagattgcctgagctcaggagttcgagactagcctgaacaacatggtgaaactctatcgctactaaaatacaaaaacccagccaggcatggtggtatgtgcctgtaatcccagctactcaggaggttaggttgaggcgcgagaattgcttgaacccaggaggcagaggatgcagtgtgttgagattgtgccactgcactccagcctgggtgacaaagcaaaactctgtctcaaaaaataaaaaagtaaaaaataaagacggtggattggctgtgttgagggtgaagatttcaagtagagagaacaactagagcaaaggccctcaggaaggagggtccagcatatgttcaagaaataacaaggagaccaatggggttggagcagtgtgtgtgcacagagaagagagggaaccaggggccagataagtgagggcttataagacctggcaaggattgcctttcaatctgagggaaatggggagtcagggtatgcatttgagcagagttgtgacatgatctggcttacatttcagcagaatcactttgactgctgtgttgagtaaagctaataggtcttttcagaggctgtggaagtaattcagaaggaaggggctagtggcttggataaggtactaaagtaaaggcagcaagaagtagttagattctgggtatcttgacggtagaccagcataatttcctgaaacacaaaataaaatcatccttgttctctaacatggatcaggaatctgtcagtttggtggttgcagctgtgtgtcatgggtctcagcttgaagaggactgtattcgttcatcgtgtgtgggaacatatgggtgactggcagggacaggcttgcagcagtctgtgctcagtgaggattccaggggcctggaaagactctgctcagagattcaaggaataatagatgagtatcagagagaatgggtgattctgaatgattttaaaatctggcactctgactgtgccctggccagtctcccatggaccatcccttaagatgaagaggtttcaattaaatagctgtatcatgaaacatttttggacattgagaacaaaaggagtaggcagaattagcaccagcaactttgtcagcaagaagagatggtgccatattgcagatattggtgccctcaacattgggcaccagcagttggcaatgatggccactttggcaggcttcagtggcattggcagaacattcagttggcattggctaaggtgcccttgatgggaagacactgggtatcatagccagagacacagacatcagtacctttgacacattgggcacctgcagctctgaagcagcccttggcattcattagtggcagatttggcaccttcagtgagtatgaagaggactgagagcacttttggtaggtcctggtggcactgtctcaagctgtggtgacagaagacatcaccacaataggctagagcaagagaggcagaaaagggcagatgtctcatggtcagcggtagtctagttaacagtgcacatgtgacaggagacactttgaatgaatcattagaaggaatttcagtaaggcctagaatatgcagagaagtgttgctctatgattgttgctgttatcctattttgaagccctggttggagttcctgaaaaccccttttatatttatagttaagggataatctaagaactattccactaccattggagtgagaacagcagtcacaacaaaaaatagcttgatctttaggaaaatgtttccagcctcatagtctgttgtatgtgcgtgtgtgtgcatgtgtgtgtgtgtgtgtgtatgtgtgtgtatgtgtgtttgtcagtctagaatttctaattatctcagacaatggagtgactaagaatcttcagctctatttatgggaatccccagtagagtcactcttacaatagttttagtagttattatttatttaattcaataagaatttttaggcactatagtgcatcatatgtataacatcattctagatattgtatatctaggacaatatatatataacatcatcctagatattatataaatgcaaaagggaataaagttcctaccttccaggaatatgtaatttccttgggtatacatttgaaatacatgcaaataaagttctgtgtcacttaacaacagggatacatcagaatgtgtccttaggtgattttgtcattgtgcgaacatcagacagtgtacttacgcaaacctagatggtatcacctgctaaccatctaagctattgctcctagtctataaacttgtccagcatgttactgtactgaaaactgtaggcaacttaacataaattactaggtgatggaaatttttcagctctattataatcttatgggacctcttatatatgtggttcatcactgacccaaatgttgttatatggcacatgactgtatacaaagataagtgccagtttttataagttctagaaaaaaatgctagagtggattggaaacatttgggtgaatttcttttatagtttctcttggggttaatatatggtgaagtaagtgattgtatgtgtgcttgtgtgtacatgtttgtcagagagagggatgcaggtgggaggggtggggggcagagagagagagagagagagacagagagagagaaagggagggtgaatatggacatccatttctctttattgtccctagtcctagtcctagtcctagcaggcacaggcagcatcctctgtctgaagtgactccttcaatgtcctagttggctaaaaacacctgttcattctttgagattcagttcaagcaccatccacctgcccaaaaagctttccctgatccccatgcatttagctcttctctcctcttgtagcattttccacatagtattctagtttttgacatatctatctctgtctaaaatgcaggcagaactccttgaggcagggaccaagtcttctccatgtttccattcccatctctggacttagcatagagctgaaatgaatagacagtctgattgaatggatggacaatgagcaatttgctaatgaatgtctgtgcatggccgtgtgggtgtttgcagacgttatgcctctggagttgctctagcttcctttcatctacctctgagcctgctgggtctcgggacacaaggtaattgttactttatgtctacatcacgtggcactcagaaaagtgatctggctgaagtgcatgataatgtaattgagtcccagaggtgacaggcagggaaattgatctctctatatttactgaaataatctcttgtacatctgtggggaaaatttcacattcaaaactttcttatgatacatttacctcttagtatttagaaaattgtaaatacaatcctttgccaccaagcagtagcttccaagtaaagaaggggttgagggttaaaactaatataatgcattgaagaaaaagcttttaacctgtcaggactctgtgattcataaattataaccttagaaatcatttaaagtgtatccatttagcacttataccttcatgaattcatggaacaacaagtaaagctaaaatgtatttcctcttgaagacatgaaagaggaatcttgcagtttcttgggtactcgtttcctttgataagggcagtagttatctattaactgaatgtctatttactaaaatacaaagcaatagacttgtgtgaaatagtaaaaatggccagtcattttttccccaagatgagtaaattgatgggtgattccacagagtacagagacggggcactccagtaataggaagtagaggaaagcagttaagggcatagactctggagccagcctggccagtttcaatcctgactctgacacttactagtggtgtgacctcaggcaagttacttaacttctttgagctttaatttcttcacctgcaaaatagggatttaattttgagatttaaatgtgttaatttagagttaatctgaagtacttagaatagtgcctggcacgtaggcaattttctatttaagtgattgctattaacataggggtttggcccagaatgtctttctggcatgctgaggaacatcttggggaacgtgtattctttagatagagttcactatggatccacagaagaccaaccatcaggctagaacccaaagccaaaggataggtggaaggactactggtttgaagtagaaaatctcattgattaccgcccctcctcatcccccacaaaaataaccacaaagaaataccacgtaatgaaacagtgcttagcttagggaaggaagaatagtaactatgtcacttgtttagcctgcttcattaagctcactataggtatttgtttgggtttgaaatatttgactcattatagcttgaaggacaaagtgatgaatgaaatttatagctggattgatggcactagctgtatttcagctgtaataaccagaggatggttattacgaatgagaaaaaatagcatctctatctgcctgttagctaaacatatgctttggatcactttttgcttggagtgtcatgagttatcacaaacttccacaacaaagaagttttcttttttaactttgatctatgtattatttgtttttttagagacagggtctcattctgctgtccagactggagtgcagtggtgggatcatagctctctgctctctaactgctgagcttaagcaaagctcctgagtagctaggagtataggtgtgtaccaccatgcctggctaattttttaatttttttggagagacagggtctcactatgttgcccagccttgtcttgaagtccttccctcacgcgatcctcctgccttggcctcccaaagtgctaggattacaggcataagccaacacgcccagccacaacaggtaagttttaaaggtacataggaatggctttttgattcatctgtctccttctccaggaacctactcctgattccctgaacagaagagaccttcccttttacttaacgtacaaaacttgttatttttactcctattatagcttgtttcatgttctgacttgtactatattaagatcatttgcatattggtctgacttcctttgctagactaaaatcttcttgaaggcagatactgtgtaatttcatcttatttttctccttgcactgtgtcttgggacataagtaaatgctcaattcatttgcagacataacttgaacagaaatatctcacttgaatgccattgatggaaaataagaaatatagccaaattctattcaacaattaagttagcacttatttcaattgtatggtaaaggcaggtgacaatgccttattcaaaatggcgaatatgctgttttacagttttcgtgtaaatgcacacagttctgcttttctgtgaaatcacaatgcctttagcaactaaatggaactacactgtcaagatctgactgctcagcttctcagttcacttccattccattctatgctatgtatatttatattgagtccttgcttctaagagatgcagacaggaagatctctctgtattaggcttattcatttaatctctctcttttttttttttttgttttttgagatggagtctcactctgttgcccaggctggagtgcagtggcgggatcttggctcactgcaagctccacctcccgggttcaagtgattctcccgcctcaggcacccaagtagctgaaactaaggtgcgcgccaccatgccaggctacttttgctatttttagtagagacggggtttcaacatattggccagggtggtcttgaactcctgacctcgtgatctgcctgcctcggcctcccaaagtgctgggattacaggtatgagccaccgtgctctgcccatttaatctcttaaatagggaggcatgagttatgactttaaacaccttctcttctagcttctgatggactaaacaataatctttaaatacatttcaaaattatcagtttagtagatgacaatcaaattggaaagttttgccagtttcttatctagaaaatgaataactgcactgtgagaaacccactagctcagagtagaatgttcactatgcaatgcagtcatgggcatttttagtcacggactctcttaggtcagtaattgagttcttttctgttacttcttggctccaggcaaaagcaacatcaaaaatgtattgatttttgttaatttagggagaatttattgaacaaatgcaagtggtcataactaatattgagttcctctaaatgtcagaaacttcatatgcatttttgtatttatatctcacaatgacctaatgtgataagttccactattatctattgttttatagataaggacactgggattagagaatttaagtaacttggccaaggtgacacaagcagtaggtggctaaactgggattaaattagatttaactaaaagctcaagagagttattttttgagcccctgcaagattgcaagttccttaaagatgacttaagtggattatttagcttactcatctcattatccccttagtatccttagggtgctttgaagtacagcgtttagacaatacagtggggtggttaagaacctctgttaagccgcctcagtatgaattctagtttatccacctaaaacagcattcacagattcccatcattttctgtccatttcttgcttaatagttctccatagcatttatcattacctgaaattatatagttttacttctttttttctgggtccctcactagaatttaagctgcacgaggacagtgaccttgtaagtcttgcttcctaacaccaaattctcaatagctagtacagtgcctggcatgcagtaagtggtttaaaaatatctattgaatgaataaataaaaggagatacattttgcttaccgtttatgcctggagtcgtaattttcaatacaattaatgggccaaatgaaccctaccttttttcttggttcagcttcaaaccttctttttaaaagtgtatttaatagacactaatatagcacatatgctttggaaaactccattttatgtgctttacaaatattgacccatttaattctacagagaaggtgaaatcattacatccattctaaaggtgaggaaccaggcacagaaagatttagaaacttgcccatggtcagacaattaggcaaagaatggagccaagattcaaactcggatagtctgaccatgttcccaaccattccattatgctgcttcctagattaatcccataaaaatgtcatttccctggagtttaatgctctaaagatgtgtctttgctctcttagagaatgaccttccatcttgcctatttttccttcctctctacccagattaagaaggaaaataaattaagattattttacttattgaaacagcacagtatgctatcagtgaagcttctctcaggctaccttcaaggataaataagtgaatgaccccggtggctgctggacagctcacatggcctatatctgcttttcttctttttcatatttgtctttttcttgtatttctagagctcttggattcctgctgcaacccttccttctagccttgagaagggagttcagtggtccatggaggctgcaaaaactgccttttaagcctgaaatgtaaaaggaaggccgattttataaatgattcctgttcttgcttttagtcaattggttctttcatttcctgtcccttttcagtttctttcacaaacacacaagcaactcacagccttgggtctctgatatagcaccatattcactcaggaggcaattgtcatgagcacagatatctgggatttagttccagttcagttactaaggagcaatcttccttggggcaagtcatttaataggactgggacttagtttcctcacctgtgaaatgactccagtgagaggaagagctggagatttaaaggtcccttccagctctaaactgtgattattctttgacgaattatgtaaggaagggaaagtgctcagatatctaaagccctatttctctcactacagattgcaggataactccaagggagccactgttctttattaaatgggggtgaacttctcagaattgaaggatgacggctgctggggatagcaatagatcagaacctattttcctgcctaattccttccctatttctctgtaaatatcagaaggagattaggagtaaaagtgatatttcagctctgtggtctacataataaacgattccaagataaattcttaaaaaaaaaaaaaacactaaaaagttctgcctctttagcttgggaagaatgtagtagccatcttgctttgtgaaactgcacaaaaaacttggagcagagcatgggtaagtatgtttgaattgcgtgctctcacgcccagcagttgtttaaaaatctatccagcccatacagttattgcgattttgcattttgtacatatggggctttgtcatttcaaagggtgcaaagagcttcatgaacaatggccattccttctctcgatgtgaccccgtagaacagactagttattggtcatcacttgtaaacaggaagcatgaatctcaccctaggaaatgcaggccgccagtgctgtcatgcttacatgaaggacatgccttatccctttgtaaaacatttaaaaataaaggcactcagtttggaaatatctttgagcatcctaacctgacccattcagaactgacctctaatcagcatttttgtttggctcagtccagtctaataaatattaactgggcattactatgttcatgatctgtgtgctccatacctaggaaaggaagatgaacatggccaagatcctaatcttgagtaagagacaaattagtcaacaggtggtttttatgaggtgtaatgggaacacagaagggttaaatcatctatcccagagagaagatgttgtaaagatttctccaaggcttaagtattaaggaatgaataggagttacccatgggaagaaggatgagagttaaggtacagaaggagatgatgtttctggcacagaatgactagattctcaggaattctatcacatattcctaggaagagagataatacttcttggcctaatttgcagtttaatgagggctatgaacctgaatcctggtgaatcaaatgtgatttaaagtaagtgatgcatttcctgtcctggcaatagaacatcccaagtgatcttctatgttcctctctaccctgctgtcatggcagcccacaaagaactccaggatggaagggtccatgatggaagaagccagggtccctgaattactggttggaggagagctgcctgacccacactggacttagcatgtgtgagaaataaatttaacagtgttaaaccactgagaatttggagctgtttgttacagtggctaggttcattaccctgatcatactgtgtgccaggctaaggaataataaaagggatctgaatgacttgctgtcacttcaacatttatatagcccaaataacttaggtttttgaccttaacattgattactctttcttcctttctcatccaatggcaccaatgatttctttcttaaaaaggtgatcttttacagtctttcagcaagtcaactgctcctcctgagtatattatcagcatcttgtgtcttttaatgacatttgtctattgtatataattatataacattatatctattattatatctattattgtataacatatataatatacaacaaaaaatgtattatcgtatatataatatatgttttatattatatatactatacatttgtattataaaatatatatcatattgtatataataggttataataggaatataatatgttaatgttatacaatatagcatgtatatataatgaaatatcatttcaaaggtatctctatataaaaatcaatttttctcattagaatacacattttatgagggcaagggcttcatctatattactcattactgtaaccctagtgctaagggaaatgactagtatatagtaagcactcacagttattttcagaatgaatgaataaagataaatataatagaatagaggctgggttttttaaaagaaatggacttcagctgtgttcagatgtaggcgttctgaaggcagaaagagctccaaacccagacgagggttgacagttgctcatatgaaggtgatagcagaagctatgcaggcaaatgaaggcgcctcaggagggtaagggaaggaagaagatgagagaattaaggctgaattttagggaatatcaatgtataaaatagactaagtataagcagctaatgaaacaatattagaaaaagtaaggaaagtaaagagagtattgcggcacagaaacagaactctgtaagaatcacagttttggggtcagatctgtgagtacagcatattcaataaacacctgtctattgattgaaataagtgctgaacactgaatagcatatagtcccatgaagatggtcaaaggggctgactccttttctaaaagacatatagccaatgtcatccctgttaattatacacatttctctgggatgacatcaggaggcttgggttaccctggggcctttcactagtctgataaagtaggctatatttctgatctgagttcttccctgtttagaagattctcagaagtatggaaaagttcttaatctagctggatatttattgataagttacgggtcagtaaactatgcctacagtctaagcctggtctattgcctgtttttttaaataaagttatttggaacacagccacactcattcatttctgaatcatctatggctattttcactctgcaacagggttgagtaaccacaatataggacatatggccagcagagtataaaatatttatgatatggcttttcacagaaaaagtttgccaacccctgagcactgagcatatctgttttgcacccccggcaaaaaaacaaaaaacaaaaatacaaaaagcaaaacaaaaaaaaccccacaagacattttcagaactgagtggagcttgtaagaaccctgggaataccacagcctgtcttactaaggactggacctataggaaatagaatattctgtgccttcggtgagactgggtcccgtcatgtatttactttaggttaggacctccatgctaacagtgcacgtatgtgggtgtgagattctctttgaccgtgtatctttaactgatgtccactgggtggtaggccaacactgagtggcagtgagtttaagacatgcaataaaaagaataaaaagaaatgcaagtgaaaagaatgagggtagatggagagtgagtgatgggatgggagaatgaaaataagtcgccctgtcaaaaggtaccatgagagcatctatgcctgtgggctatattttgtcattgcccttctgaaaaataccagaagaaataagaacaagtttctatcatttttctaagtgacagggaaataagactgaaccttcctttctagacttttaaagaaataacattggttgtacacttttccgctaaagcgtacacacatctgcgtcaaccatcaagcctagaatcaataaacatctgaatgttaaggacttagagagcactagcgtctttaagagaatgactctgttctcttgaagatgctagttctttcaaggtccttaaaattatcttcatagaatgtctctgttctcttaaagactctagttctttcaaggtccttaaaattcagatgtaacttctttgaaagaatgtcacattcctaatactcctttcaaaggctgaaataacctgtgatctcatcatattaagacatttctagagtgattctcttcatctatgacataggggtagcagagtgacacctataaccaaatctggcccccaatgctttgttttgttaacaaagtgtttatgaaagaaacccacagtttttttggggggtgaggaggggcaggacttctgctctccagtgtgccacagtttccaccactccatattgtcttttctttaaaagtgtttgagttttcaatccctacaatctctgcccacaccattttgagggggccaactgttgctttgatctattttcttcgttcaggcctaaaattaaatgaccacttgtaactttctagctatgttagtttattagaacccgttttatttgctaacattcttcaagttttgtccaatagagtttagtagactcactgacctaatatatatggtaaaatactcttttcagtaatgaggcaacaatgaagaataaatacattttaagaaactgtgctgttttatgggattactgatttgtgtatatcacttagatcagtgatgttcaggttatgaagtgattatgtacaatttgcaaatatctagtgtccctaacttctgtattatcttatatcatgctacattatacctaactctacagaccagagacatgtgcctcttttttgagtggcagtagcaaaggtggctcttaaatcatctgactgtgaacaatacagtcccaggaagatggcccaaggaaataaagggtgtttttttccttgtagtttttgacggattattccattttaactacaaatgtggacaatggaaactaggctgtaaagtagatcattataaaatgtacctggccaacttctaagatgtaccccaccctgcccgccctaccccatggtccccaccgtctggtattcacgcccttgtgtaaacacctctattatgtatgaactgaatctggtgacttgattgtaatgaatagaaaatggcaaaaagatgggatgtcacttgtgtgattaggtagcaaaagactgtgacttccatcttgctagcactttcttgtcttctcacttgcttgttctgttgaagctagctgcatgttgtgagatgctctatgtggtgacaaggaactaagggaggcctcagccaacagtgtgtgaggcactgaggcctcagtccgaaaatccctaagagcctgaatcctgcctacaaccatgtgagtgagttaggaagtagatcctcttgacttgagtcttgagacagctgtagctgtctgaaagatccagagacagaggacccaatcaacattgtacctggattcctgacccacagaaattgggagataataaatgttgttatatgccactaaaatttggggtaatttgttctttaacaatacagaatataaatcatctattggaataacagcaaaaatttttttagccaaagcctcaaactgaggatagagaagggggtaatttaatccattcattcagaggttctcagtgccattcagtgaaaaaaataaatatatgtagctccaataaatattggttaaactgagcagaactcagaagtaaagggccactaaaattcaggtgttcattatgtagtaaagtaacagtagcaatgaacaaaagtgaataccagacgtcgcactaagatcaagagtcctgtgataacaatatttactagtcatcaaatatttttgggtttgagttttgaggaactccaggatttaaccgaggagaatgagtaggcagagagacaacagcagagatgcagagagtaactacgtattgtggaagccgaaagaagacaatgttaatagtgaaaatttgccccatggggttaacaagaatccttgagcttgccttgcaagaagacagacgaagaaacagcttgttataattctctctgcttgcaacaaaactggctgactggctgaaactggctggaaccaataaggctgactggagtcagaatggcacagaatagactcgctctcctggggggtgacgttttgatgtcacagcctgaatttccacgtcatgtttcagaccagttccccatgaatttgcacaggcaacccacggaaaagcacgaagggacaactgcgcatgctcaacggactttccaaacttcccattcctttctgccaatcactaaccaaccgggaagccccgcccccagaatctctcccttaaatataccgctttaaggctggtacagggcgacggatttgaactggattcctgcctccttgcttggccgccttgcaataaacctttctctctacaaaatccagcgcttcagtgtttggccgcaattgtgtgcaggcaaatgaacccagtttggttgataacaataattgtcaatagtatcagagtctgctgaagtcaaagtagggtggagataacaaagggcttatggaatttctgatcttctgcttactggtgaccttagcactggttgtaggaggtcgcagcagagaaacaactcaagcccttgagggattagtggagcaaaggaaatggggagacgttgagtatagacaactactaagtaattccaaaaggtattataaaactggaaagcattagaagaagaaatattgaaaaacagcgtgagcatacaatataaaagttgcttatgtgctgaaatatactgtcaactcaggttgagggatatgaagagagcagatgcgatatgagccttgacacaaagtcctgcaaacctttaaaatgaaaatcctttgaatgcctgaccttcaggtgttatattatcaaaggacagaagcgtttatgcccttttaaaaaggaaaatgtattagaggattatccaaagacttggccacatacaattcttttctggaaaaaactaagttttatgttgaaaataagtaatcaggtaatatccctgtgtccaaagagacagaaaaagcacaataaacttaacatttctaggacagtagaaaaaaagccattttcttgtggaactttgggtttgtttcctttcataaaaagggaaaaaggtgaaatttgatcttcaagaagtccaggaaagcttttagagctgagaaaagacagagttggggttggtgagggaagtagactctgggtgaaaacggataattaagctttacaaaaggtcaagcattgcaaaagacagcgagaaagatgcattctatgtgttgaatgtatcaaatgtagttgagaagatgtaaatcttcgcattggtgaatatttcagtattaaaaaagacatattaaagaatagctattcttacaaaaggaataaacttttttctttgaagcttgacacaacatatacaaataaaagcatgaaaaatatgctttgaagtgtgctaacacatcaagattgtactgagcaaagcaccttttctctgtttaggaacaatctcactaattccacaacacaatatgttaattaaaggatcccaggtagcaatcatggaatatttcttctcatgacagatgaagaatacaaatattctgaagactgaaattgtataaacaaaatgaagagacattttgtccgttttctggcagtgcaaagttaaagtgaatgcagatgaatgtgctggcaataaaatgacactattaaccatctgaagatcgggctcattacctaagaaggcaaagcatcaatttgtggcattacaacattctatttgtgctgctcaatgtgcgtctggatgtttttatatactctctactaatttgtgtgcagagtgagctcttctgcatcagcctctctatagaagcttaattttgtattgtttctcttatattattttctctaatgagaatgatattctgtattagaaataaacacttcatttattcttcaaataattctacgttcagtttctcttgttttgcattatcaagtggtgtgtacaggattacagatatatcttaaaattgaggtgctctgattaaaaatatacatttgaatgacatgtgaggaaaatattcattcactcagtcactcactcattcattcttaaaagaatgtctatgtattgggttaagcatcatgggaaattcaaggatgttgcactgtctctgccctcaggatgtttatagcatagaagtggctgaatgttattagtaccttgagataggaacaaggacagggccataaaatctcagaggaaagggaaggtcagtgtattttctcataccacaagtattacttgggtacctactatgtgacaggtgctattctagaggctggatatatagaaaagagaataagacagtcaaggtccctgaccttatggaccttgcttcctgagggtgagatggaaaataatgaagaaaaaaagcaaataaataatataacttcagatcacactaagtggcatgaagaaaaataaagcagagcaatagcaagaacagtgatggtaagggaaggatgtgaattttagctcatgaaggcccctgtgaagatgtcacattcgaatagagatttgacaatgtataggagcaagtgtatgaagttctgaaggaagggctttctaggtagtgggacctttgtaggacaggataaagactttattctaagtgggaaggaaattcactggagaattgaagcagggtatagcatgacctgatttatattttagaaggatcattccagatactgtatagaaattcaattatagaggggtaagaaggtaacctggacagaggttaagcatctgtgaatagtccaggatagaggagaacaatgagaacttgattcatgtagtctaaccaaggatgacagactggaatgcactgtggtagtccatctagatagaggtggttggtgaggactaggttgataattacttagatggtaaggagcggttccattttgaaggaagttgcacaaaggaagtgatatgatatgataatatctgagttgaactttaaatgaatggcagcatgtgacaaagcaagtagtcattcatggatttgttgagtgcttatctatttttatgaaccaggcactgtgctaggtgctatagatacagcagtatggaagccattgctgaaagtgagaacaacaaaacttgctgagaaggtaatattttaagtaaacatacacaagcagagaggtgaacaatatgctcataggaattacttcctgaattggttctaaggatgttttattcttttccatttagtgtagaaaattatgtgattaaactcctttgtatatttggctcagtgaatttgcaaaaggagtaagtgtctatcagtagaaattcaattcactgtcagttgggaaatttcatcagacaatttccttagaaatagtggctaatatttacttttcccacttagggagggagaaagtatagcctctctagaaagaataggaggataggagagtacaaaacctaggacaatctcaaatatccaggtgtatctattacagttcatctgccacctgcctccaatctgccccacagtctttttgcaaacagatgacccaacttcaactttccctccttctaatcccacttgtacactgcctctagaattaactggcctaaagtagtccagtcatgtccattccccagtgcctacagaataaatttcaaattcctcagcctgacacacactgacccaacctactttttctgctttatctctgactacacacttctcaattgttttaatcaccttgaattttcttcctctttttaaaattattttttgaattgcatgaatatgttatgaaatacacataacataaaacttaccatcatcgccatttttaggtgtatatttcagtggcatgaagtacatttgcattgttgtacaaatcccattggattttaaatgtctatttccctcatacttccagcaatttgttgcctgaaccaaatttgtttttatatggttcctggggcctcctgaaatgccttttcccatccaagtactaaccagacccgaacttgcttagcttccgagatcagacgagatcgggcacgttcaggttggtatggccatagatctgaaatgcattttcctttccttatcaattaaaatcccacatatctgaaagattcatgctcagattttgcctcttcctttaggctactttgacaccttatctggaaacaggaggtcaactctgttgctaggtaacacactgcttacagtaaaaatgatgcctggttggtaaattgcatctggactaggagggcctatacatgaactataaatacatgatggggatgtgatactttggacttccctgagtaatgactcgtgtaattaggtcccttgtagggaccatggaggataagtctatggagttgttgcaggagatatcgtctcttatggggcaggaggcttttaagccagggccattcctgcacccacccaatatgaatctagtcttcttgaacctgagctgccacctggggggccagaactgatatttgtactgatattaggactctcactgaagagaaaatctgaagcttccctggtggccagcagtgttttctgtatcacatttttctaggtaaatctcaagctaagggttcatgcctgtaatcccagaagtctggaaggccgaggtgggtggatcacctgaagtcaggagttcaagaccagcctggccaacatggcaaaatcccatctctactaaaaatacatacacacacaaaaattagccaggcatggtggtgtgtacccataaccccagctactcaggaagatgaagcaggagaattgcttgaacccaggaggtggaagttgcagtgagcctagatcataccattgcactccagactgggtgacagagagagaccttgtctcaaaacaaaaaaacaataaaacctcaagccaagtgtggcccatagtagtctcataagtctgaatgtgcagttggacctaagaagatctgctcttgaggttgcatcaatatgtagaactactgtactaaatacaaatactccttgcatgcctggactcaaaatcactgggaaccgtacacaggactagggcaataaaagtattgctcacctttggaaggagctggattgcctgtagaattctttgtctgtgcccagaattaaggattccaatttccaacaaatcctgatcttccataacattgcttccctgaaacaaaacagaaatgttacaagttaaatcaagcatttatactgtggataaataacaaggatttatttaatacagagaaaaccagtgagtgacctgatttttatgaacaaagacatagagtcattcttccgtgagggtgagggcagagtcggtcaccttgttactgatgtgaagtctaggagaaagctcccctcccctcacaaatatctatcgtggcttatatccacatggggttatctgcactggagattcattcgtgtgacttaaaactttgtttctgcacattgtgcacatgtaccctaaaacttaaagtataataataataaaataaaaataaataaataaaaaaagatccaaaaaaaaaaactttgtttctgtaaaaatgtgaatgcttctagtaagagttgccatttaagattatcagtgacttacacattgatatgaatgaatcatttttccccccttgatgacagattttgtgcggaaggctgatagaaaaattgacatatattaggcaggttaaaagtgagagttaatacttaatttcaaaatattgagtcacaatagcaaacacatagaatcaacctaaatgcccatcagtgatagcctagataaagaaaatgtggtacatatacaccatggaatactgtgcagccatagaaaagaatgagatcatgtcatttgcagggacatggatggagctggaggtcattatccttagcaaactaatgcaggaacagaaaaccaaacaccacatgttctcgcttataagtaggagctaaatgatgagaacacacggacgtagaggggaataatacacgctggcgcctgttggagggtggaggatggaggagggagaggatcaggaaaaataactcatcagtactaggcttaacacctgggtgatgaaataatctgtacaacaaagccccatgacacaagtttacctacgtaacaaactgcatgtgtactcttgaacataaaataaaagttaaaaaaattattgaatgccagacaccagatcacgatatgaagattgaatgatgaatatgatgcagggccctacccacaactgcctttattccttccagtcccgtgatggaaagggactgttcaaaggcagttaggtaggatgctgagactgtgctatgatggtgacacttgcttaggagtccagagggaatccagggtattttttcagagaaaaggacatctaatcagatataggaaaaatgggtggttaaggcatagcacctaaaagaggaaggacaatggggaaattatgtgcaaagacctgtgagtaagaaggaatgtagtatacttggaagcatcatgttctgggataatatggagagaggagcaaacggtaaggctgaatgagtaagcagagggcagaccatacagatattgcatgccatgctgagggcttcagactttatcctgaccataatgggtagccatggacagcttttaagaaagagagttacatgctgagattccaaatttagaaacattattttgatttctggggctgggcctcagtttccctacctataaaatgataaagttgagcccacaatgtccaaggaccagttcagtcctaaaattctgatttcaatggttattttaaacctgtgattaatatttgaatgcagaagtttacatattgctcattttatccctagattttaatctttcacggtttgtaagacagagtttctctttaaattgaggcgtctatagaggttcaagaattcagatcactattttttttgacaaatcaaactctgtcctacttatgtgtaacacaaaaacgcaagaatagaaatgacagaatatccatttatttagtgatgagtaccattagacactcaaagcaaaggagaatgaatttgaaagggtgattctggggcatggagaccactgtggttgttttctagaggcgctgtgggcatagactaacgtagtagtcacaggagcaaaaagaagcaggtggatttgcaaactatcaggaagtttgacgtggagattgaacatgtggaatgatgcagaaatgtggaatacacaaaaattcaaggcttgggcagtgagtggaacttgatgccttttcctgccataataaaggaggaagaacagccctggtggggcgcaaagtgagactaacatctttccctggacagggacagaatagatgcatgtaaacaacttaataatatcagactatgctataaatggataactggctgtgcttagaaggattaaagccactggaatggcacaacagctagggatttaaaacgggcattcactggacaaaagcattccacctactcatagtgtcattcttatgcttaagcaacaccagccatctcggaggaagcagaatgatccaggtattcagcagcatgataatgaaaagcctaatgaaaaacaaataaagccagtcttggcaacatgccacaggaaatattgctctcaagaaattactcagtgcacacaacagagcatggctgagaatacaaatgacttcatttagagaaagcgttattatttccagaaatggactagtatggcatgagcgagatatgtgataccattctgacttttactctttgaggagttacctggcccttaagaaaaaatctttcgtcatctttgtgctagaacattaccaggttttccaggtcctaacttaccaacccacaacttcagcccatgtagaatagaggacctggtttttttgcagaaacagaaagcatacgaatatcccatagtgtgcatagctactatctctaggtaatcctgacaactggatttcagtgtttgaatactgaaatgttttggtaaattaaatcctaaagatcactgttcttcctctacacctccaatatgctattttctgtatctcagtaagagaggagtccttttgaagaattatagggaagttagatatttttaaagaaggtgttgagtacataagaacatctttttgagccaaatttcctagcatataggataattgccaaacatttttgaaaaatgaaccaaaattatgggaagcacaagaaaaatagtgaaaatgtgtcaaaggggaaatggcactaattgggaaatggaaaggaaaggatttactgtccccagtgaggcatgctgttagaaattttctattttatctttttctataatacatagggatgccaaaaatatcctagtacatcattcagccagccttttgtccaaacactaggggacttggagtctgcagaactgggtttggatcatggcggggcaaacttggctaagtcatacattctttgtaggcttcctggtcctcacccaccaaatgaagcagtttaatgaatatgtattcagtttcaaaatgctatgatttcagccatgtttgatttttggttggtatcattatatataaatatagattgtatattttgaaattatgtttcagtgtttcagaatttgtaacctaaaattagctttaagaagtgattaaagagaaattcaagaatatatatttttttttgacaaatcaatcttggtatgatggacttataaaatttcttattaaaggaaattataaggtaacttatttttgtagtagtacggattcttatagcttttcagggaaaaacaaaatgtttcaaaccttataactatctaaccatttctttggcacctgggtgacagttgtgccatcaaagacaataaacattcccattcttcctagggagctggaattaattctcactttatcacttgcctttactaaatgctagcaaatctcagtttaacttctgttttttttttttttttttttttttgagatggagtttcactgttgttgcccaggctggagtgcaatggcacgatcctggctcactgcaacctctgtctcctgtgttccagtgattctcatgcctcagcctcccaagtagctgggattacaggtgcccgtcaccatgcctggctaacagggtttcatcatgttggccagggtggtctcgaactcctgacctcaggtgatccatctgcctcggcctcccaaagtgctgggattacaggcgtgagcaaccgctcatttttctcaataaaaactgaacacaactctagctttcttcctcctccatcatttttttttttcacataacttttaggtcaatgatttgggggcagagctccgtcatgtccatcttctgtttagtcatctactacactgcactctcaatctcctttcctacccagtacactccagtcccatgttttcatctcccattttcctcctcaacccaccagaataagctgttcccccccatcaactccatagaacttctctgtcaaatgttaagaatgacccctcaattgccaaatatagttgattcttttaaatcttgatttcaagaatttacttgccatatgtaggtgatggccaccatattggacaacaaagatacagaacatcgccatcattgtagcaagttccattagacagtgctactctacagttagagacattgaaactttagtcaaatcacaaaaatggggcagtagcagggaatcaaatcagggactcaaaaatactcatgagtttttctcaggatgtagttattcatgtgcctcttagtcaaagttcatgaacattaagtttaggatctttagcaaattctcttttaattcttcagtcaccaaaagaaattagaaggttgttctactttcagcaacatttctttatggtggggctataaatctatgctatgaaaatgacaagtccaatcactaaattatttttgactttcttagcatccaccaatcacactgcataaggtgtttaaataacaataatcaataaataaagttgtttagttaatgactttctagaatgatcaaagacccaaatgcagtatttttagaatagctgttctttgcctgtcaagaaatgtctaatgcagggtgtctttattgatctcttaaatcatggaatggaaaaagtcacctaatgttttatgcactaatagctgaaagtggaagtttctttgaccacggggagaatatcttaggtactgaacttcttcagctgtgataaactgttaggatgcccaaatagaatgaaaagcagtgttttgtatttaattattcattagaagtaaaacagctatttaccaaaaacatctcaaaaatatctgtactgatggctctgtctctccaaactctgcatttaaaatttcttgtagttttttaaacttaatacgatatcttattcatttagcaagctttccttcatattatatattgtagaaaatgttaggaaaatatatttaaggaccacagggaactggcttattcttaatataaacttgagttggataatgttatttattctcttccttcatccagtccaagactaaaaaaatcaagatgatactgttgattggggaaacttgtttttgctctataattagctaaattagattcttctccacaatttatgtgaccttaaatatttaaaatagaatcactgtataatagaatgacagcaagatcttacaaacttacacatagaaaaacatgtactttagtttgcttttaatatttagccttttataacataaatagcatggtagcatgaaactgtacataattttcttggaataacaatgctacctctctgcttctataaaagctttgagtcaatttgatatcaatttacaagtaaacccaatgcatgtcttctctgcatgattatgataatggttattgtgctaaataccagatttattattcctctgtcagtgttggaacaaagctttatttagcttatcatatagaaacacgggtgactataactgatcagataatggatgatgtgcttcttccaactttaacttcctctctcacattaatgaaatggcagtggaagaaaattctatagtacactaaaaaatccctctaccctaatcctccatttaaacatattctgtctaccgcaataaaatttcttgcatacaacttaagtaaattttcatgtttttagcttatgaagaaagctttctggattcttcagactatgtggactattgattcaaaaaatattacatcactgaccaataagacatcatcttatatgtgcaagctgtgtattttaataaattatatcttaaggttaagatatagtttagcattatatatttaacagctaccatgattacaatgaattttctgtcaccgattttttcctctttatttttgaaacccaattcccctttgaaacatctgttgtcaagctacagagaaagagaaggaatttaagtaaccaggtatttatttgttaaagtatcgagcaggatttggtgatatcataaattataaatgtaattcacttgagatgtgttcatgtaggttttagaattatgtgtatttgtaaaagagtgcaaaataatttatacagtaatttgtactgcctttggtcaaaaattttatagctatgagagaaggagcctattcttcatttttaaggatgctaacccagagctccttcaagtaagaagaaaagttgatgtgaacaaaacttttttgtatgctcttacttctctccagatgcatatatctgtataaatataaagctgatgaatacctactgtcttccttcaactttcacactgatagcagttggtgttcattagtgtaaagtaaatagcacacttactgtgtcaggcactgttctaaataccttccatatattactttatttaattctcacaataactcctatgaggtaggtagcttgttcccatagctgataggagactttctcaagacttaccctatactacctctagcaggaatcatgcaggagataaaaggttgagttaaaaaaacatggttagatccacaccatttatatttttacttcagagtcatctgaaattcacatttgaaagcgagtgttccaatgcatttatgtttgatttcacagtaccgaagcaacaatgaaccctctctatggaagagaacttggagagctgtctggcctaatcttccctgctttgctccagtcctttctgttcactgaatcctggaatcaggcttggcagggacctggggggtttctagtttctagtctaaacgttccctaactacccacaaagcttcaacttctcttttgaagtgtggtgtctcactgggttgacaccatccccagagaggtagggaggatattaaatgctttaaatggtctttcccagcagctgagtctgagcagggggtgcggctggggttggggtggcacctctgtcctactcttttagctcccactgtggtacagaccaagtgttgcaggagagctatctgaagaagaacgtgccagaagcggagatgaaaggaaaacagttagcagctgtcctgtgtccttttgtaatcacaagctgtgaagctgaaaaaaaaaaaaaaaaaaaacttccttgggtaggctgtacataatcttggcagatatctgagtgttgttcttctgtctaatatgctgaacgtttcccagtgcctcacaagagaaaagtgagacagggttaggtgagtttggacaccttgctccgaacaggcagggaacatggcgcccttgtacgttcatcaagctcttgcaaatgccctgtcactgtagatgctgatgcagagctccaaaaggaagggctcctctgcaggagaagcaaaaagaatttgctcctgggtattcccaacacagccacatataatgacgcagaaagaagtacctaaaaagattaccagccattacattcactgtgtagcaggtacttcacccaccttatttataaaccttacagcactcttgtaacataggtggtattattttcatcttatagaggaggaaactgagtctcagagatgtgacactatggagtcaagttcacaagataagtataggatggatctgggatctgtgttttatttggtcagactctgatgctgatgcttccttcactacataaaaagaaccaaatgtttagtaggggacattttctggatggagattccggtccatagatatgtaacgttaccaagaagttactcccatgaccctattttcacacacacaagcttacatctatatttacagaccatagggagtgactgccagagtttctccaacacattgaatttcacataaattatttatcttctgaaaggtcaactggttagttctccttctaaactaccttagtgtattccagaaccaaacatgttaatcaaagtgacccaaggtgtttgtggctaaagcactaactaacttgccatgtttcctgctgtgaggcaggaagtatcagcatggcattaggttgttgtgagagattcagctcttctgcagtgccttgtcaaacgacctgactggtcaactgggaaaatgaagttctcagggccaacatcgtatttgggtgtttttcttttaggtctgtatcaaagccagatttaagaaggagggtgtctacaaatgaacgaaagcagaggatgtctggggacaagctaaggacatttgtgtcccacactgcatgtattctgaatccagagaaaagagagtgagttgcagtctcctgagaaggctatccaggctaaggagcctgtgatggtgaaggtggataatttagccctctgagaagtgtagacctgtcaaaaaggagattcgttaattcttcaaagatatggttgtcttcaaagaacagacatccccagatttaaggatgatggggtctcttgacactgagaactacattcagaaatagccaaacaagaggaaaggagcaaagaggaagagaaagggagggaggaaatgagaggaagtgtttattcttaagggtgaaggtagtggtgaagggagtagaatttcctgataaaatacagaaattcaaatttaagtggcatcatgtatttttattcacttaatctggctgccttagacaggaggtcactgaaatctggaaatgagctggcagagtccagtccagagctaccactgaggcaggcattgtcattcattcatgtagtcagcatttgtttgttcaataaatattttttgagcatttattatgtgccaggcactgggctgtggttgtgagatacaatgagatcaggacagacaaggtccctctacctttagaatttacagtctagtggagaaaaagggaaacagtggaataaaaaaatagataaataattatttagcaaagttttactatataccaagtatttactgtattagtagggactattaagcactttgtcttgtttgttgttcatgataaattctgatgttagtatatacaattattatccttatttacagataatagactaagaattgaaggcacagaaaagctgataattagtctaaggtcacacaggtagtaaaactgacataaagggaatcaatggagttctaaaataaaaaataaacaaataaataacaacggagatctatgttagaaagactggtgaggaaagtctctctgagaaagtgacatgtaattaagacctgaggggattagaaggagcagcctaactgtgagaagagctgttacaaggacattccaggcagaaataacagcaggtgcaaaggcactgaggtgaggaaaaaggtgaggcatgttttaggaacaaacagaagcctactaagaataaaatttagtgactgagggggacgaagacctgggaaagaaacgcaggaaataagacaatacagagacttgcagactctgataaggactttgattgtattccaagtgcaatgggaaacattgaaggaaatatactaatttgcatcttcaaatatactctggattcggtgtggagaatggatggagaaattgggaggtatggaagttgagctcgacaatcaaaattgaaataacagcctagaaacataaataatctaaaggaaatgtgatgaaatatgaccttttgggagactatgggaatgggtctcactggggggggggtcaagtctccaagccaaatgcatcttttatttgaatcaaagagaaaagccatatgacaaggatgaaatcagaatagtctttgataaaggttctatgtggatacaactatgaataaagatttagcagtacctacgaaaatgaaaatgttcagactccatggacccagcaattctgtttcttggtcgtggcagacattgctgggaggctgagtcctttccctctcactacctcccactgcagaggctggataagctaaagttctcagcttccctttaaagcaatggttgaacatgtgacagaagttgtcattggggaacttctggaaaagcttttgctttcctaatgaaaagggaaaaattcacctgctacccttctgtgcccataagaaaggactctcctcaggatgagtggctaaacagttcagagaaggtgacagcgatgggcccacagtccttggacctccaatgatagatatctccattggatacctggaggcaggcaaggataggccatggaagggttagttctgcataaaaaacgttatttaaagctctctccatcttttgcatctaagttgctctgactagtgtttatctgtcagtgaaaataatgatggggatgtgtactgtggcatgtaattaatagaggttataatggaggcaacaggatatttactatttattttaggcagacaggggtatgataacataaagaatagcagagaagggatactaggaagaatgaaagttatcagatccaagttggggtgtgtgtgtttgtgtgtcaattatagcattgcctcttctcattttgacttaacgttgtgaatttctcataaaaagatgacttgaaggaatttctttactctggattttggtttctattaaaaactaaaacggatgcaaaattgccaaagtgctcatgggactaacaggttctaaatctgggagtgggtttcagcttataattgaagatgacaggtgtccagagattgtatgaagttatggttctaaaggaagtacagttttacataaacctggtattctacaggaaaaaatgttactcttgaaatccaaacacattataatcataacagggcagaaacaataagaacatttaggggtatgttaggttgaccttagtgtgtagctcttccaggaactcttgagaagtcagagtttttatttaggtcctttgtaatctggaatgcctttggtgggcagtgaatggcgattattgaaagagttgactgatagaatattcctgacttttccccacatttatttttagttttggttttggtcttgaagacatttttcttaagatgtcttcaggaaaaaaaaaaatttttccacattgaaaactttgttttggctttttcgagtttaaaattcggtgatgggaaaacttgctcacatcacaacaatgggattaagtgtgaggagatgatcgctgtgggcagacaggcaggaggctaaccccacgaagggctaaactaaaagctgagtaagagctccactaagaagagctctttgaactgttctgggactggctagggccactaattgtccttgggttgtatatgaagggaaaatttgtatcagggacacaaatatccttgtcctttgtatagcatctatatcatgaaggatattctcattttttaactccattttcttcactgaataatattactcaacctgaaagaaatacaggggaaagaaacggagggacatgcattctcacagtgaatgtaattaaatgtcctcctgtctagtttttcaagttaaaggttctgagttttgtttccagaatattcaactggtactaaaagcatcatgaagtccctcatatttaattaaatggtgcattattaaaagggggcacactctatctaggttaaagaggtgataaacagctatagaatttcatgtttctttctacttggtattatatgtcttgtttcctttactggacagcaaacttcttgggagaaaggatcatgcctgaagcatctttgcatctcccctaacatctgtttgctaagtgttgaataaaataaaagcttgaaagaatgaatctgtaagtaaaaacatgagttttttagatttattaaaaaacatttagtctaaagatcactaagtaagtttataggaaaagcactgaaattttgagctggaaattctaatatgcaggatgcctgatgtgtttttcccccctaattgaaagaaagataaagatggaattgctggtacaccataacaccaaaatgttcttaatttttttttcagttttgcaaattctcatgatttgattttcatccaggactgtcagttgagacatctgataatctaaaagcattcagagaattaggatcccatatggctcgaaaatatttcctatccggcaggaaaaagagaacataccatgaaaataatactggtatatccttcaatttatgtgtacaaggagcataaataaatttaaatcattattcaaagtataataattataatgatcataaggttgattataacaaccaaaataaaaagaatatacagttcttcataatcatgtgacattataaaaaatcagaagtatacttcaaatcaatgatagtaatagagttgtgtttgtctaacagaagcaacagtcattagaaatgagcacgggattaggagtcctggcttatcactaattaactgtataaatctgaaaaggtaatttaactcccttaggtcttaattttctcaactgagccatgaaagggctagaccagatgttcccttttaacacggcatctgttctggaggttctaacaaggagtacatctactcatacactcctattgcctgaagaataattaattcttcttgctttgggggaaatgtcattttcttcagataagtgttcagtattgagaggtgcacttacataatggtgagggagcaaggagacctgggcttagtcatctaatttcaccaacaaaattattactaacaataacaataacggctattcattgagagttaactgcaggccagacactgtgcttttatcctctgaacaattctataaaatagatatcgctattatcatccccattttacagatgagaaaatggaagcataaagattactaggaacttggctgagatcacacagtaagtggcagagctgctttggaaatgaagatgggtgttggaatcaaattcccctcaccccactggcttcccatagctttgacaagtgtcttctgcatggaattgcctcagagatctgatggatggagtctttctctgccagcccagtcgtctccatgaacctcctttcctacaatttctacccagggattgaggattattaataaaaagaaaaggaattgagtgctcctgggttcaccttacagctctgcactttaatagcagtgtgactcaggatcagcaatcctctttctttgtccgtacaatggggataacactaatgcttatcttttaaggatatggtgacataatgtttatgaagttgctttataaactctaaagtaaaattgctaaaaataaagcatgcctgctaggaactactttttttttttttttttttttttttttttttttttttttttagaacatagcactgtaaatcttctagtttcatgttgtttttgctggaaatagtctattctgaaagaggcagcatgtgtgatggcagaaaaattcagggttcccccccccacccccagctctgccatttacttagctttgtggccttgggaaagtcacttgatctggcatcccacagggtcccatactctacaggccctgcatttggggtttaatttctgtggttgctgttttgaagttcttcctaatttttttctttgagtttgtgtgttataagtgaagtctgaagggacaacggagcatgcgctgggcttggcaccttagatcatgggaggtcttgcttcctgctgcatctccaggatgggttctgccagagaccctcttcattggtctctctatctttagtcctgcccaacctccctttctctgttgagtcctaaaattgctgccatccttcactcctagcaggagtctgggtgccggcagagggagggcttgggtgggtcactcaaacccatggcaccttggggccgagcatggcatcgcccatccctgccctaacaggtagcagcattccaaatcaaatgggtgaccagccagaagctatcccaatccagatatcaagcatgtcctgatgaagagatttaaaaatcctttgcggggtgggggtcccctgtctgctatggatggaggtaatgtggcactggataaaagagatgcctggttagattttctgggaccctgctctatccaggacactgtggtagtcaggagagtgttgggggcctggcagtggggcacctgtgccctgcataggaggcacggtccagggtgcttgcatggggctgcactctcactacaagtgtcttgtgccttggaatgctcctttggctagctccatgcctggagcattctccctccttctaaccgtcctgggtttggcctgtatttgtcttttttgaccagatcaaggcatcctttggataaaaacacaaaatataaactggggaatttggtattccttcataggagttaaatgctttaatattttcatctaaaagtaacattgcacaatataaaaatgaatgacaaaattcatgctaataacataaaattttaatgtttctttacacagaacattaaatagtaaacaaaaaacaccatgacaagtctaaagagagaccacaaaaggaaggaaaaaggtttgtacgtatttttaatggcactctttcccctgccttttgaatagggggccccacattttcattttggactgagctccacagattatgtagctggctgcgctcccaggatgtaaggtttgcataatcacctggtccttgcttcacttcacaggtatatttgcagcagctctgcttgtagttggtaagctcagttaagcaacatagttggactgacttaagaatagcttaccatccaatgatctgtggctttatctttacctttccaagtgggtagaaaaggagtaatgggagccattcccttggaaactactgaggtcatttaaccctaacaaggatgatgcttcactagatgttaattagagatcatttccatttttagttttagttctagaggttgccttaaaaattatgagggcaacaggaaacactgaacttgcctagacttctggggcttctttattcattgacttattcattcacccattcaatcattccctccttcactcacactatcatttcacaacatttactgaagtgctatcatgctgcccacactttaagtatggagaattcaaaagtgattgaggcagtctctctcctaaagaagctcaaagtcactgggggaggggtaaggtggaggtgggatcagaaggcatataaagagattatttttattattgttttgagacagagtcttgctatgtcacccaggctggagtgcagtggcatgatcttggctcattgcaacctccaccctccaggttccagtgattctcctgcttcagcctcctgaatagctgggattacaggcacatgccatcacgcccagctaagttttgtatttttagtaaagattgggttttgccatgttggccacgctggtctcaaactcctgacctcaaatgatccacccgcctcagactcctaaagtgctgggattacaggcgtcagccactgtgcctggtcaaagagactatttttttgatgcagcacatacaatgattatggctgtacagagaaaagattcctgaagtacacagctttggatcaggaaagacattttgggaagcggaacatctctgctacctgctaaatgatgaggaaaagttaaccagaatacaggcaatgcttgaagcaagagagagaaggcactgcgtggatcggttgcagcatgaacaagggcaatgagaaaagaaacggtatagtgagagtgaaaaccagaaagcagtttacagttaaccaggtggaagaaacagggagggagagaccaggtagccagccttgtaagcgatgatgtgaagtgggcttcatcctgtggttctgggcagttggcaagttgttttatgcctggaagggagatggctggatttacaatgtagagagcaaactccagtggctatctgaagtgtggatttgaagggctaaaactggaggttggaagcccatttaaagagctcttgcagccataatacaagagacaatgaagatctggactaggacagcagcagcaggaatggtgatgtattaaagaaatactatagagccaaaactgactgaacttgattattgattaaatataggtattggtagaagacaagtgttaagaataactgtcagcgctcttgtttgggtaactgatggttaaggagtcaggtgagaaatagactttcagaggaggtagagggtttggaggtacagtgttttgttcttgtttttgagacagagtctcactctattacccaggctggagtgcaatggcatgatctcggctcactgcaacctccacctcccgggttcaagcaattattgtgcctcagcctactgaatagctgggattatggatgtgagccaccatgcccagctaatttttgtatttttagtaaagacagggtttcaccatgttgtccaggctggtcttgaactcctgatctcaggtgatccacccacctcagcctcccaaggtgctgggattacaggtatgagcccctgcgctcagccttgaggggctgtgttctgtttgggacatgcttaggggcctgtggaactggaaggaggggatgttagcagacagtgagaggaggctgaagtttggggagaggttcaggctaatgttgtagatttggggatgatcagggctgaggtggtagctgtatgaaatggataaatgcagcactgagaagaaaggggaaatgccatgagagaaagaaggaaaagatgaagttaatgaggaaaagagggagagtgtgtcgtgtcagatgccaagagggtaacgagtttcatgaataaggatatgaaccaactgttaaatatggcagagaagtcttaatggaagtggaaaaggccctttggtttggtaaaatacagcagctcatgaggaccccaggaggagttttccattatgggtacaaaagccagattagaggattgtgagacaaaaggggtggagacaatgaatgtagacgattgttttgagaaatctgaatgagtaagggaggagaaaatgtgcagcacagctggagaaggaacaggatcacaggaagttgctttattttcttcttcttcttcttcttctttttttcactcgtaagaataggaggtgactgggtgcactgggtcatgcccgtaatcccagctttttgggaggctaagataggcagattgcttgagcccatgagttcgagaacagcctaggcaacataggaaaaccccatctctacaaaaaataaaaaagttagctgggcatggtggcatgcacctgtagtcccggctactccgggggctgatgtgggaacatcatttgatcctgggaggcagaggttgcagtaaactgtgatcataccactgcactccaggttgggtgacagagtaagatcctgtctcaaaaaataaaaaactaaaaagaataggagactcttagctgggcatggtggttcacactgtagtggtggccacctgggaggctgagatgggagggaaaattttttgaggtcaggaggttgaagctgcagtgagctatgatcacatcactgcaccccaacctaggcgaccgatagatatgtgttttgaaaacataacgctcagagcaggttgaaaccctgtctcttaaaacaataattgaaaaaaaaaaggagacacttaagcaagtttgcaggcagcaggtaaagcactagtggagagggaagttggatccacaggagagggaaaggaaaactgctggaggtaggaggggtaggcctggggtgagataaagggcctggaagagggaagcaaggatgggtgaggtgtagaatccttactcctgaagcccttcactgctgatacttctgctatccttggcatgtgacaattcctcaagctgaggtcaatgccactgtgtcaattgcatagcaattctctttcttggggattcctataaaaactccctcataacaattccccaagtctctagtcttaccttgacgcccctcagtcttacacaattccttgctattttgactagtttgaggttacccatcatgaactccttcgacatctctcctatcttgatttatatactcttcttggtctcattttttcctgcaatattaaaaattctactgatctttcaaggtccaactcaattgatatcccttatctatgtctcactttcatcttacatatacatttttaaattacttgatgtcttttatgttatcttataagctaatttaaatacttcttaaaacaaggaagggattcaatcaacctatcaatcgtcatgataccctttcctatctcatcttcttttcatcttcttcaactttttgactcatttttatatcattcctctatgaaactattaaaccccttaagggcaagtaaatgttttttgcacctgctctagtatgacaatacattatacataatacctacctactacaattaataaattgtaagctcctggaggacaagaatttaggagttagctagctagatagagatgaatacacatgcagagatatatttacattctctcaagtataccaatttaatctaatacttactatatacttgctagcaattagagatatataaagataaataaaacaaaacacagtctctgtcttccaagggtgccaatccagtgtggcaatcagagaatgagagggcttgaatgacatgctgataaaattggactgtattctgctaggtttcttgcagaacttagggcagaggatattaatagatatgtgttttgaaaagataatgctcagagaaggatgaaggatgaatttgaaaagaatgagattgagggtaggcagatctatgagggggcttttgcaatagtgtagatgacagataataaagatcaagtgagggcaagttggttacagatgagatattgagtgtatatgcgtgtatgtgtatgttgggggagtgaggttgtggtgcacaagaataagtgtccagaagttatttgctaatcttactttttaaaagacattaaatggtaaatagtagtaataactatagcttattacatatcgtgtaacacattcctctagactggccttaggcaatattgagatctgttccatttcaccacttaggatcctctaggcccgattttggcactttattctatatgatcggctatttgttcttctcttattacttcaggtctcaagttttgatcatcctatgagcccatatatccttcagagcaagacaatgtgaataggcatcgttgcacttggtagagggttaggcaaatagtggatgccaaataaatccttgtggaattgaatggtattacctggagttccctgaaggttgtacatcctcttactccttggcctttggaacgtccttctctatacctggaattcttcctctctctctttacctcctctgactactgtctctttacctcactttgaccttcctagttctgtttatcacttcctctaagagttgttgcttgatgcccctgcactgggttagcagattttgctaagtggtccacagaatcacctacttatgtgtttctctgccagctctataaagacagaccagactaccttgcggtaatttgttcagtattttatccccaggttgagcacagcacctggcatacagtagacattcagtaaatatttgttaaatgaacatggttttgtggggttttatttgtaaatctgaacattttgaaatttgaatcttcaaatagctggacataaagtgctagatccatccagacgaaagaaataatgggagaccatctagaaaagtattttgttctttatgctattaaattcagtagaaattagttattatattttttgaggactgttatgcaattaacactctggacaacatgaagacagttcagatttcacctttctatcctgccccccaaggacatgcaaaatatctgcttgggtacccgttttttcatgtgtacacactagcatcttcagttgataagttcctgtggggcaggaacagtaaacttctcagaattagaaagcaaaagtgacagcaaaaacacgacaacatcagaaagccagattctatgtcagaaagtcttaggagttgtagctttagtgttctgcagacaacccaatgtcacaggaaatactaattcccttgctctggggcatttattaaaaacaaaattttttgggaggccgaggcgggcggatcacaaggtcaggagattgagaccatcctggctaatatggtgaaaccccatctctactaaaaaatacaaaaaattagccaggcgttgtggcgggtgcctgtagtcccagctactcggtaggctgaggcaggagaatagcgtgaactcgggaggcagggcttgcagtgagccgagatcatgccattgcactccagcctgggcaacaaagtgagactctgtctcaaaaaaaaaaaaaaaaaaaaactaaaactaaaacaaaattttacttcctactgcctggtaccatattatgcagtagagacagaggggttaaggaaatcaggcatagtccttgttctcatgtagtttgtagttaaggagtgagagaactggcagtgacctgattttgaagaggctgattcaggtcaagacccaattttgaagctggtctccaacaagaagagtggtttctaggaatatagctctgcacaagcaaatacatatcccttagacagtctgtgacatggagtgaaaaaccctccctgacagatcctttactagggatctctgcaagggctcagatctctacttcaatagaaatgctcattggtactatctgaggacgatttttccaagaggcacaaggagatcaattactactggcagcctaatttgcaagataaagaaatttcccattattctagtatcttcgcaaccacagtctacttcagcatcatcagccgacatcatggcatagtggaaaaaaatttggaatagctaaaaagtcacagattagaagttctcatagctgagatgctgctatgtgcttcttgttaaaatccagggttaggacaagggtcagaggattcttgtccttctacacttgagtggcctacagccatgtattcttctaaatcatgttttgaatttcgtcttgaaagataatgttttaagagtgctaagcttatatactcatacaacagaaataatatgtgtgataaagttgggcaagaagtgcttttaaagttgtcggtttctaaaggtgtctttttttaaatgggtacttaatagttatacctatttatgggatatatgtgatatcttgatacaagcatacaaagtgtaatgatcaaatcagtatccatcatctcaagcatttatcatttctttgtgtaaggaacactccaattctactcttttcatcattttggaatacacaagaaattgttaatcatagttgccttattgtgcttcaaaaaagttgtcttttaggttgtcttaaaatttggttacgaattgataacactagtcagaatcatgatttatattctgtagatcatttttttccatttagctttcagttataatacctcacagaataataaagcttgataggttaagtgtcttggtcctgactatcttgagaataatggttggagcaagaactatggtccagacgtctgctctagctgcaatgtttcccctccctactccattacaccacaatgatggatgaatgacggatgctgcagcagaagtaattacagtaaactcaagatataaaaacaattaatatagtgaaaatatataaattaataataaatataaaatacatgcatctttaatattaagatgtaatataatttataaattaatatagcaaatacagtaatatctaatggacagtgaccccatcaccccacttttacacgtgcctctaagagccatttcttatttttgaaggggagcagctacaccctcactctttgggttgcggtgccgtgtagaagtgatgagaatgggaaactgatacactcctgcacagagaagccaatctgaatgccagatgattaagtagaaacctccaccatgctgcctcagacttacaaatgaagtgcaaattaaaatgttagatagacatactcaacagcctgtaacatcacaaggactgtctttggggtatccatttctataaaaagaaaatctggcattcctttttggaacattaggccaaagtagaggataatgagaacagaaatgccttatgcagtcttaataatctttctactcagaggattcagtggaaactagtaactaaaaaagattagccttgcatcaagaccgagctatccagaaatcgcccggcctgggatgcagattcagtcacttaagtgagttgtaacacaggctcacttgtaggtttgccacaattttcttgcaattcagttccttcctctgtcaggctgcaataatgagatgaattcctgcaagaagtactcccagaaagacacagggaggtctgagtagataactaacacagatatctagagaacagaagtgctagacgaagagagaaataaacacacacaataattaaaacaaagatttttttaaaccatagcgacattacacttatctcaatctttaaaatccaggatatctatatctttgtgtatttctcactgaaactttccctgggcctcccaggaagaacataaagaataaagaataggttcattttcttacagattaagagatgtgaggctcaaatgaccttatcctggtaacatagctacattactgcaagagcagcatctttaatccctatgattcctactccagtcactctttaccagtgaaccatcaaagtaggtgatgatgctgaaagaggtacagaagattcagcttgtgaagataagccgaatgacagaaaatgcactttgtgcaaacctccatgcagtgatcacaatgcattttagccagtggttcagttctctctctgtccaactagactatgtaccttgaggatagaaaccatctgtccacctaatgtccccagtagtcagcacagtaactaacacatagtagtcaattaatatttgaagaacgtataaatgaatgaatgaaagcatgaatggatctggaaaagttgccatcaggaattggggccctgaagaaagaatggggttcataaataacattcagcaatcatagtcactgaattgggtactaatattagtgaaaataatagagacagtaaaaccaattataaatagataaagaaggtagtgcttgttctgttttgtttcataaaagattgacaattttatttatgaacacaggatttgagctaaaaagagaacagataagaaggtaggtgactaaagaaatggttgccgagaaaaagtatgaaacagagtttagaacagagaagaggatacagagataattgtaaaggtgtttgacagaaaaagggaaaaggagaaaagaaaaagctttcagtaggacactttatgggcataatagggttcttctttagggcatttcggaagttgagagagcaaagatgagaactcgagagacatggaatggacaaaagagaaagggaggtgagatacatggtactgatcactcacagggaatgaggaagggaagtaaatggcctcaaagaagtcatagctgtcatcgagcagcaaatgccttctgtcatgcaggtggaattaaagcttaaatgtgaactgatggtccatcttcagcttctttctcttctcgctctgatacctgccctcaaggttgctccctggctggtcagggaactcacactgagctgtagaatgttcccaggctctggacctttctgtactgttattcaaccatcagcacttgctagcttctgtcctattctctcaggatgcctgtttttattaaatgacaaaggaagttaattggttcatcaagtagagcaattcctattgtgggcttagctggctactagttaccttgcctattacatataacagcagtgaaataaacataaaggaatgaatgggtgggctttcattacgtgccaggccctgagctagatgcagcagagtatggcagaacaggacatgggctttggagacagacacacccaagacagaggtctggtccataatttcctagctataagcttgaggaagttatctcctagggttcttggattcttcatctgtaagatatgaagaataatttcttcaccctcaatttcctcctctatgaaatggagataatgttgcctacttcgcagggttcaaaatacatataagtgataataatgttatttactatttattcatttatccccactttaaaaaggaaaagctgaggcacagagaagtaaggtgtgactaaggtcacctagctgggaaattctagagctggcatttaaatctagcatttgtctttatgcacttacccaacatactatgtcatcttaaccaatacactaaagcatcattagatgtttccatctacagcctcttacagtggggaaacagtttgatattcaccaatctcatttaaccctcacagcacctctgtgcagtactaacatcttgctttaagatgaggaaaggaaagctcagagaaggtaaccgtggccaaaactcaacataggcccagagaagggaacaccagccaaaactcaaagagctaattagtgacagaacttgaaattagatgtagggtttatgaccacaaatataaatataagaaagagagccaactctgggcccagagtagatgcccacatctttactagttatctaggtggtatttctacattgcttttaaagttctctgatagcaaagctgaaacctggctaggtgttgtaagatagatgagaaactgcaagtcaaggtgtgagttcaatgagtggattttaactcctaacttcaggagtactggtcaattatcctttactgagtggtgctatcagcccacggtaaaataaattagatttttaagaaggtgcagaattgccactataaaatcagataagcctactgcagttgggaataaattctatcatagaaatacatcttgcctgatatcaaaggaagccaagaaaccatgccaagagttggatgaaaactgacattttctgctgtggagacagaagtggtagcactgattggagaattatattttgaagagttctaaaatatttatcatcattctaggtcatttattcatttacccttttaatgctcatttcttttgtgccactaggtcgagcttaaaagcaaagaatgaaaattcactgtgtttttatatattaatatgaagcaggaagtttctctattgcttggtttgaaaaataaaagcgtttctgagaaatattagaacactaaatgttctttcagaaacatggcttttgtcattaataaggatgctgggtgtatctaagcgtgttatgaatttgtacttttttttgtttgataacttcctgtaacttgaagtatttcaagaagggaaaaagctgataaaaactactaaaattgccattgcttcactgtattgattgccccattatgtttctttctagacttgactcaggcatctccttctccaggatgccttttctgctctccattctaattaagatggccttcctctgtgctccaggagcatttacacaaaccactatccatcactgcccttatcacactgcatcgaagctatctgcccgcacatctgtgccccctggaaggcaatcaggacaataaccatggcttatattccacctggtgtcctcagcacctggcatggagccagaactcagcaaatttttaccaaagaacaatgaattttaaaacctgactatagaatggcagaatgctccttctgcctccacgaaatttactttcaagttgaacaattttattaaaaattccattttctaatggtatcagagacctgcaaagctaaagaaaaagcaagtcttatttccaggtcagaacttatttcccaggtcctcactatttggcttatataatattaaaaggtatttttaagagtataatttctatttctcaggcttgaaggatacttttgttagtgtcctcatagctttctattttggctttgcatccagagaaatgaaagaggcttgactcagctgccgcttaatactgcacaagcctgagagagaagactattatataagctaatgtgtattttaaggtgtttttttttttcatagccaatacctaaatgccaccttccaacctcatgaaagtgctgaaccccagtgtgtgggaaagcgaggtcccctacacggctctgtattccttataagtataaaaaataaaagcagttgattaagggttagcaattttcttttctttctttacacgtacttgtaattcatttaatgcaggaagtgggctgagttttcttgttctttccaattcaactctcagggagctttcttgccagcctgctatggttaccatggcaacaaggcgatggtggcagtaatatgatctcatatgccttgtgtcaatagcatcagatcatcacgcttgaggataattttgacaataagcttcagatatagattcaggatatattaccatttgattgatttaccagaaatactgagcaattacagccttaaacttctaataaaagcatgttcacaaaggttagcgtttttccctagatgacatattatatggcattctgaaatttgtaaattgctttcatatatctgcttcaattctcattaggcaggacagatataatcatccccattttatagaagaggaagtaaaggcccgtgcaatgtgctgtgtaaggtggcaaaagcaactccacagtgaagctgaaacttcaacttgaggcttctggcatcagaatcacactttcctcatgcctgtgttaagaattcatgggtattatcaaaatgttcttagatgcataggttagaccctggaatgtctgaattaaaataatgtaaatgtatctgtgataaataactactagtttgagaatattagtattttatatttgggtgatgcttcatacattttatatctcccattacaccttcctttcctaaggcttttctgatactagatgcacaaatagatgcttatctctttctcccactgatcaacatcttgtcttttttgttgttgttgttattagtgacatttatttttccattgtgagttccttgaaagtagggatcatgttattcattcttggaaggtccctgatcctggcacagtatgtatggatctgttatgtatcaggtactgtacataatatgtaccaggtacataacagatacaccataaatgcttgttgcttgttaaactgaactcatctgacacccacaaaccccatgaggtaagtacagctggcattatgatccactattttaataaagtggaaatagaggtcatggatatatcatgggcaatttaattctttccactcccagccatgtgctctttccatgtcgtcctgtttgctttattctttcattgtttctctttcattcattaattcatcaaacatttattagttgctctttctatatcaagcattgctacagataatgggttacaaagataaataagacacaatcctcagcaccaaagggctcacagataatgcagataattttctgcctaggcaagtagtaaaataaaaccttatatggaacttcgagtatgcattatattatttcccaactttattggctctttaaaatgtatcttgagaatatgtttcaagtccctctttaatgcagtgttttagaactggataagccttgagccattgccaatatagggtgatactaattctgcatcttcgttttttttcttgggcataaaatcagcatttccaacatcccacagaatccctaaacttaacgtgtcctcaatgaaactcagtatctgacctgaacgaatgggaagtggcagaaagaggcagatggtcagggtgagatgccagactctgccgtttgatatgacttagggtcagttacaccatctaggggtttcttcattagtatctggcacgaaacacagtgttcaaaatacttcttaaatgtattaattaatgaatgagttgtcaaagaggatgaaaaatgatgacataaaatagggatacctgaagcagtgttagcattagcaggtactcaataaacatcttttaaagagtggactaaatatatacgattcaattccccttcctgaaacatattaaattgccaagacaaaacttctaagttatctttatgtctctttccacatcatagagtcaggtttatttcacctctgcaatgtcttggacttgtgcctttctcttcatccaatagcatgatttgatccaacccccaccctttcactagtagactctcagagaaggcccttgactgaacttcctctctttccagggtctcccattccaccttactggtgaaactcttatttttaaaggataactaggagtgtataactcttctggccagagattttgtattgatttgtatattctaattaagaaactttttagaatggtaatcaagatcctctaaaaggtgatctttagttatacctatagtcattcctttccatatactctaggttttagcttcccctacacacacttttggacttttaagctttcttcctgtattcctagttagtggagtaataacagctttgtaatacttttgcacaacactttgcaatttgtaaggaactcatatatgtttataatgaaactttgtgataacctcagagtaggtggatatgatcattttcatttcaccaattaggaaattgaaaatcagagagttaaatcatacagattctcataacctttatgagaattctattggaaaatatttgtgtctatgatgattgtttaaccatggaatacttgaatcaaactctttaaattaacaactgtgacttcaaaatgctaacgattgacatttgttcagctcgttagcccagaggctaatcatgatgcttttcttctgcatagcaaaagaaactatcaacagagtaaatagacaactacagaatggaagaaaatatttgcaaactatgcatctgacagaagtctaatatacagcatctataaagaatttaaacagggtgggcatggtggctcatgcctgtaatctgagcactttgggaggcggaggctggtgcatcacttgaggtcagaagtttgagaccagcttggccaacatattgaagccccatctctactaaaaatacaaaaattagctgggcgtggtggcatgggcctgcaatcccagctactcaggaggctgaggcagaagaattgcttgaacctgggagatggaggttgcagtgagccgagaccgtaccactgtactccagccttggtgacagagcgagactctgtctcaaaaaaaaaaagaacttaaattcacaagaaataaacaaataactccattaaaaagtggcaaaggatataaaccgatacttttctaaagaagacatacatggagccaagaatcatatgaaaaaaagctcattatcactgatcattagagaaaatgcaaatcaaaaccacaataagataccatctcacaccaatcaaaatggctattattaaaaagtaaaaaaataacagacgctggtgaggttgcagagaaaaggcagcacttacacacgatgggatcataaatttgttcaaccattgtggaaagcagtacggtaattccttaaagagctaaaagcagaactaccatttgactcagcaatcctgttactgggtatatacccagaggaatataaatcatcctcccataaagacacatgcatgcgatgtttactgcagcagtattcacaatagcaaaaacagaatcaacttaaatgcccatcaatgacagatggaatgaagaaaatgtggtaaatttacaccatggaataccatgcagccacaaaaaagaacaagatcatgtcttttgtgggaacatgatggagctggaggccattatccttagcaaactaatgcaggaacagaaaaccaaataccacatgttctcatttgtaagtgggagctaaattatgagaactcatgaacacaaagaagagaataacagatacttgggcctccttgagggtgatggttgggagaagggagaagagcagaaaaaataactattgggtactaggcttagtacctgggtgacaaaataatctgtacaacaaaccctcgtgacactagtttacctatgtaacaaacctgcatatgtaccccacaacctaaaataaaagttaaaaaaaaaatgatgttcttggctgggtgcagtggctcacacctgtaatcccagcactttgggaggctgaggtgggtggatcacttgaggtgaggagtttgagaccagcctgactaacatggtgaaactctgtctctacttaaaaaatacaaaattagccagctgtggtggcgcatgcctgtaatcccagctacttgggaggctgaggcaggagaatcacttgaacccaggaggcagaggttgcagtgagccgagattgcaccattgcactccagcctaggcaacaagagcgagactccgtctcaaaaaaaaaaaaaaaaaaaaaagatgctcttaagctggattgcctgtgtggaatcctggctctactatttcctagctgtgtggtcttggatagattacttaatctctctgtccttcaatttcctcatcattaaactggggataccaatagtttctattgtgtaggattgctgcaaggattagtgaattttatgtgcgtaaagtgctaggataatatctgacacatagcaagcactcctaaatgttgctacccttaaagacacaacctaagaacttctttggctagtccctggtctgagaaggaaaatcaattccttcctcattggtgctaccttgtttgggtcttctatactggggacactatagctgcctcagggtgttggctcaggatagattcagaatatctgaatctacttattgggagcagtcactgagtttctctaagcctcattcaccatctgaaaacacctggataataacagcattttacatcataggattgtggtgatcattttattaactagtacatataaggcatctagtgcttggcatggagtaactaatcagtaaaatttagtgactattactgttacataaatgttttgcccatgatattttgaccttcttgggttaggacctgtctttttcgttatctttatgcctatctttgttgcttcttcacagtagatttaaaaaaaataaacatttaaataaaaaagattttgcttatgagtgtcttggctatatgggctcttttttttgttccatatgaaatttaaagtagtttttttctaattctgtgaagaaagtcaatagtagcttaatggggatagcattgaatccataaattactttgagccatatagtcattttcactatattgattcttcctctccatgaacatggaatgcttttccatttgtttgtgtcctctctgatttccttgagcagtggtttgtagttctccttgaagaggtccttcacatcccttgtaacttatattcctagatattttattctgtttgtagcaattgtgaatgggagttcactcatgatttggctctctgtttgtctattattggtgtataggaatgcttgtgatatttgcacattgattttgtatcctgagactttgctgaagttgcttatcagtgtaaagagattttgggctgagatgatggggttttctaaatatataatcatgtcatctgcaaacagacagtttgacttcctctcttcctatctgaatacgctttatttctttgtcttgcctgattgccctggccagaacttccaacactatgttgaataggagtggtgagagagggcatccttgtcttgtgcccattttctaagggaatgcttccagtttttgcccattcagtatgatatgggctgtgggtttgtcataaatagctcttattattttgagataagttccatcaatacctagcttattgagtttttagcatgaagggctgttgaattttgttgaaggccttttctgtacctactgagataatcatatggtttttgtcattggttctgtttatgtgatggattatgtttattgatttgtgtatgttgaaccaaccttgcatcctagggaggaagctgatttgattgtggtggataagctttttgatgtgctgctggattcagtttgcctgtattttattgaggattttagcctcgatattcatcaggaatattggcctgaaattttattttcttgttgggtctctgccagattttggtatcaggatgaggctggcctcataaaatgagttagggaggagtccctctttttctattgtttgaaatagtttcagaaggaatggtaccagcttctctttgcacatctggtagaattcggctgtgaatctgtctggtcctgggcttgtgttggttgctaggctattaattactgcctcaatttcagaaattgttattggtctattcagggattcaacttcttcctggtttagtcttgggagggtttatgtgtccagggatttatccatttcttctagattttctagtttatatgcatagaggtatttatagcattttctgatggtagcttgtatttctgtgggatcagtggtgatatcccctttatcatttatttaaatacaaaagatttttcaataaaaatgattaaagtagcaggatagaacaatctttgcagagaaaatcccaaactctaagtggatggatgctgagactgtatgcaaaaacgctaaattctagaaagagttaaatttgaaaatatctattcttattacaaaatattgatctagtggttgttgggaaaatataaatgtaccatataataaattgggtttggattattaaaattctattaccttgtccacaatggaagcaagaatataaatgactttataaaactaaaaagttttaaattttcttctgtacattggcatatctcacaaaggaatggaattggttacactgcatatgagaacattttgatgcagtataatcttttattgtgcagctttatatagcaccctttcctgaaagagtgactgtacagcgcctggtgttctaaatccagtcgctaactcaaaccttttcactttcataaagaggttttgggaatgaagttaatattccatttaccaaactaaaatataatattatgtgctgcaatgctgtgagcccacccacccaccagactgcagataatcttctattcatatgctcaaatcaagtactatgcatatttctagctcactatcaaaagtaactgcacatatacacaaagaaaggatagaagaaaatgaatgagcagtcaaaaatgactgcaggcgactttaacaatacaagatcagccatttttgacaaatatttgatttgaaattcactgatcttctattaggactcaagggctggcaggagtaacgaatttcctgagcttctcttatgtatgttcagaagtattggatcagtttttggtctcggggtaacaacaatagcagcaaaacagtaacagcaaccaacatgcactgagtttacttcacaccagcactcaggcagaacttctgcttcagcagggtgaataagagcccccaaaggtatcagatcctaatccctggaacctgtaaattatgccttattaggagacaggaacttgcagttgtgattaacttaaggatcctgagatggggagattaccatggattatctggatgggccctaaatacaaacacatgtatcttataaaatagatggaaagggagctttgacagacaaaagaggaggaggcattgtgaccacagaggcagaaattggagtgatgtgggcacaaatcagggtatgctgacagccgccagatgctagaagaggtaaggaacatattaccctctagagcttctggagggaatgagcccctgctgacaccttgattttgcccaagtgatacttattttgaattcctgttctccaaaacttggagagaagataaatgttttttttagccagcaagttcatggtaatttgttacagcagccatgggaaactaaattaagcatccaaccattgaactaatatactaatatattgctgaactttggttcattccttcataagcctcccaaattcttgatttctttgttctgtgggggctgctgctggtaagagtagagctattaaagcatccttccatgtgaagcatcacctgctgacatttttgcagaatcccttccattgtcagccctacctacttacaagttgaaattgacacacaggtgcagtgagtcaaggtctgacttgaatgctttgcttttctctcagtagattttcttaaattcagcaagtcctcacttaatgtcatggataagatcttggagattgcaactgtaattgaaactatgtataaagaaaccaatttgaccacagtcaaatcaatataaacaagagttcagttcctatggtatatttctggtcaaagaaagtaatcaccaaacttctaaataaagaagcaaatacttctaatattaaacatcaaaataaatgggagctatacatacatttaagaaatattaatgaaaaggaagatgatgatttacccaattattccagttcaaggtcgcctgtcccggcaactcagggcaccaggtgggaacgcaccctggacgggacaccctcccatcgcagggcatactcacacccacattcgcactcactcagactgggaccatgtagacttgccaattcacctagcattaagcacatccttgggccgtggaaggaaaccggagtgcctggagaaaacccatgcagtcatggggagaacaagcaaactccacgcagacagtgacccgggctgggagtcaattttttttcttatcaacatcataaggaaacagcattacaggaaatggtgtaacttgaggacttgctctatagaactacacatgccattatttcagtatgtttcttttcttgtttgatctcattcatttgcacacttgaatccaccaataattaaaaacatctgtgaatataatcaatacataagtaatgaatttattgtttctttgggccagaaaactgttaagaacttgttatatgcaaggcattggtttagaaaccagatattcaatgataaattcttgacctcacttaaattcttattgagatgaaaagaaatattatcaagtcacaaacagtacaaagctgggtgtgaaaatgccataaggagaagatggagacaacgctgacattcagatttctggcttaaatgactgaaaaaatagtgatgccatttactgacatgggaactgcaggagaagcagcagatttgggaagagcagtggatttgaggtccctggggggcatccacgtggaaaaacaggcctgatgttaaggagagagaacttagaggttttgaaattatctgggcattggtgataattaaaatcctaggaatggaactcattgctcctggacattgcataatgggagaagaaaagagaggcttagaaaaagtacagggctagtaaagcgtatcgcatattaagagaatgatgactaacctaatttgagatttaaagggatctgataggagataaattaaaaatcagttgggtctatccaaagaggataaccctatatgccagcctccaaaatttagactttttttttttttggtcatatgtattgagtcatagttagaggttttaatttggggactagtaggattatagctatgcttataaggtaaatccagggtagtgtgtaggatggacattagagagaaaagacagaggctgaagagttgagttggaatgttaatgtgatgatctagaattagaggtaatgaaggcctgaagaactgttttaacagtgtgtgtatgtaggtatgtgtgtgtgtgtgtgtgtgtgtgtgtgtgtgtgtgtattttccccccaaatatactaaataaaattggtatcaacatttcttatcaacactatagggaaacagcattaaaggaaattatgttacttaaggtacttgaggtttgatgttcactcaaacacttttgagtatttatttctgcattaaaggtcttgcatttcatacatacaggtgaaaaaagaggaaggcaagatgtcaagagaaaaaaatgtggcatatggcctgacccagtttatttgttgagaactttgtggaagcaggatcagtaggatgcgctgcgatgtatcctggcagtggagaggaaagttaataataaccatagccacgggatgaacagtggctgctcactgagtgttgctaagggccatcaagaggtgaatgaaaagaattatccttttgttcccttcatggagatgctggcaaatgaactgaatttaactcaatgaaccacaaagcctaagggtaactgttttcctttgtggtttgcttattgaaagtcactgctgagctgatacgggtgttggggacaatgtctttgaccttggagttcttaaaaccatcctcagactcaatgaacagttggtaaggttttaggaatgtcctagcaaaagcactctggattctgcaggcaagtgggataattcctgaagtattattttaaaaattgtgtgaaacagtggaaatacactatttggagtcagatagatgagggtttgagtgccatttctatcacttggtgatcctgagaaaatcagtctccttaagccttaggcaaaatggggataatgatcgattttgtgaaaatgttaataaaataatatatggaaaaataatatatttgaatttatagatgagacttaatagataaatgtgactgccctcccatacttaaggtcactaaaaatattaattaagagtatgttgaatagaagaatttggaaaagaaaatcaagctagagagaatgggagaaatttccttaagaaacaaaacataaaattttattaggactatttgatttgcttaactgaaactctatcaaaagccattttctggtttttacatgaatcttcaaatatttctaatcagcagtttttctcttaactgccactcagcttttggttggatgatgcagagatgtaggtgtttcgagtaactaatacaattcccttctagggtatgttgcagggtgccttaacttactgtgtatgcaaggtaaataactcctaatatgagacaacaaacaaaatacatgtctaatcaattcagaaaaatgtttaggaagctccataaacatgttttcataaacgcttgctggcagccaacttgcctggctttcagagttgctataacaaccagcagtcctctcagcagccttggcactctgcattcttacatcttttaataagaaatatcattatcttgtctgggctcattagctcaattatttaaagcatggtactagtaaagccaaggtagagggttcaaaagtatgcattagcaagaaaattctatccatgtgtcctttgccaaggcgacttgttcattcattcattcatttaaaaatatttattgaatgtctgccatgtgccaggttctgttctaggagctagaaataaatcagtaaaattaaaaaaaaaatatatatatatatataaacatgtatataaaccaacaaaacaacaacaacaaaaaaccaacaaaaaaaccccaaaaaaacaaaaataattaagatgccagttttagtgatgtctatagtctggtttgaggggcaagaagggagacagatgctgactaagcaacaaattaatatacatgtagaaatacatgtagagtgagaacaatgaagacaaagcagggaaaggagacaggtgctgtgttagggtgaggagaaagtgcctcttgatatggtgacattagagcagagatttcgatgaattgaataagaaaagctgtagctaagtcatggaagaacgttttaaacagaaggttagcagggcacaagctctgaggtgagagtgtgcttggccggatcaggaccagccaggagacctgtatgactggggtattagtcagggttctctaaagggacagaactaagtggatagatgaatatatgaaggggagtttattaaggagtattgactcacaagatcataaggtgaagtcccacaataggccacctgcaagctgaggagccaggaaaccagtccaagtccccaaacctcaaaagtaggaaggtagatagtgcagctttcagtctgtggcctaaggcccgagagcccctggcaaatcactggtataagtgcaagagtccaaaagccgacgaatctggagtctgatgtatgagggcaggaagcatagtacaggagaaagatggaggccagaagactcagccagtctagtcctttcacgttcccctgcctgcttttatcccagccacactggaagttgattagatggtgcccacccagattgagggtgggtctgcctctcccaacccactgactttggcaacaccctcacaaacacacccaggaacaatacattgcatccttcaacccaatgaagttgacactcaattgtaaccatcacaattggagtggagtgctcaagggaagaacagaaggtgatgaaatcagacaggaagagatgatctgtccatgcagggtcttggaaaccactgtaagggattttagattttattctgagtgagacaggaaacgaatgcagagttctgagtaaaggggtaatataatctgacatctactttaggaaaaattgctttggatccagagactctacgtaggggctcaagaaggaaaggggatctgttaggaggttattgcaattaaacagaggagaggtgatgacagcttagagcaggtgccaaggatttaagaaataatcagactctggatgtttttagaggtagtgccagtgggatttgctgatgaaataaatgtgaagtttttctcttgagcactagaaaaatgaagacagcatttccgccctggggaagactgaaaaataaaagcatgcacaaacttatttgtgtgcatgtgtgtgtgtgtgtgtatgtgtgtaaggcagaatggagttgtggatgccttaatgttgagatttctgtgagacatctaagtggatactttcatctaggcaactaaatgtaaataataaaatctctttatagatttcagagttcaggagagatgtctgggctaaagatacaactgtaagagtcatcagtttatagatgtaatgtaagccacgggtctgaataaggacacctaggaagtaaaaatgatagagaatagaacacaaagaactgagcctttgggtaatacaatgttagacttgggaaagataggggaggggcatccaaaaggagagaatgagaaggaatggcctgcaagatggaaaaaccaagagataatgggggtattggaagaaaattaattcaatatgaaggaatttatcagttaagtcaaatgctgatgataggtcatataaaatgagggctgagaattgacaaattcggcaatgggaaagtcactgatgactgtagttagatcacttttagtagggtggaaaagagaaaaatttcctgttaaagagagaatagaggtgaagatggtgattacaagatcttttgggaggttttgctataaagtgagctgaaaaattggacagtaactgggggtaatgtagggtaaacagaattttaaaaattcaaatgaggacttattgtgacatgtttgcatgctgatgaggataatcgacagagaggggaaaattgatgatgtgcgtgagagcaggggtagtgaagcctttgagtagacaagaggggccacatagtttaaatgtgggaaatttcattcattcattccaaaaagttaagcaaacatctaccatgtgccaaatacacagctaagtactaggaacacagaaatgaataaaacatggttcccattatcaaagaagtcatttctttgggagggagaataagcattttctctaattaataattcacgttcaatgcagtgatggtaatgtcagagaaatgtacccagggctcttttctgggatcttttcattacagcatgctgaatcttgggctgccatgtcattagaagcctagattcaagaccttcatttccatcatgcattgacatgttctgggctgtactactgatgagactgatttaggcaagagttctgggcatgaattggtgctgtggctgcacagataaagtcgaggtgatagatttgagaactgtgtgctaggtaaatcagcaatcctggtgattggttgacttgaagtaaggtaaagaagagggaggctcaaggataactcctaggtttcccatatttagttttatcctggaagcgaggatgctgataaacagattcctaacaggtagcgtgggtggataagaagaagaatctgggcccttttcttaaaaaaaattaaggtctgataaatacctgatactttcaaaaatatttgaaagcagccagatatttctgtctataaaaagaaaaaaaaaatagacctgatctctataggatgtcacaaacgctcaaaaaataaaagataggaaagactaataatacaatgctagaacactttttgatactacctaagagacttaagaaaaaaaacaccaaacccccaaaacacagagttcttggtatgatgtatttgtttttccatagaatggtttgagaaattcagtgaaaattaattggaacatgtggttgtcattcacatggttccagactttatgggcttaataaaaacattatgaatagtttttggagttttgggagaagcgaacatggctggtctaggtatctgcttttaggttaatccctctacgcaggaagtttcacagtgtcatacagtgcttttcaatttttcccactcaaatgctcccactatcagagggatgagaatgagcttccctggatggcagaggaagaaagggggtagggtagtctgagggtgtaacttgaagtttcaagttgcaaacataaagtttcctttaagtctagtatttcaatttaacagtttagcaaattttctgtgcaattccgtaaaatattcatttctttcatatagaaataatagagtctccccctccccccaccttaccctgctctgaatcactgagtaaaacctatgcatggcgaagatatgtcatgttttatctcatgactttgattgcatccttgtatcctgtcacaaagcaggggaaggggaaagacacagaaccaagtttcaggaggcctggactcttctacgccagttcgacatttattttttaattttctttgcactctacttatttccaagaggagttttggagttgctgtaagacttttagaaaatataaatgatctgtgccttgatttccttatttctaaaaacaaagaagttactctacatgatctctatattcccttcttatcgattaagagtctacccacttttggtccaagcaaaatgttaacagggctagtggatggtggtaccaaatgtatactggtaaccgatcaattaacattttggaaaaaatggaatattcagctaagatttgagtcatgatggaaaccttgaatttaaaaaaaactaaccttgggagattattagaacttagaatccacatatttgacatgtgctgtaaaaagaggttatttcttgagaagtagaattgcaactttctgctgaaaaaatatcaatcctccaaggcatcctcagtaagcccacaggcaaactcccacctcagcagactgaataatttgcctataaaatatcacgttgaatttgggaggctgaatatggtgggaaaagtttcatgtaggagaggacctgccctggagatgctcgctgaggtggcaaaggcaactggactctcaaagtagtcctccgtttaacaacatccctttctcaggtacttctctcatctgcccgattacttttttttttaaagcctgacaggaatgatgcttccagattctgagatggtaacaatgatctaaatagactgtcatcatttatcagcattcacaaagagaaaacagctatgaatttccagtgggaaaaaaaactttagaatcaaaaaagcaaaaggtacataatgctgtatccagtgaaaacttataaaagtgtaatgttcgctttaaacacaatacaccaccctgagagggttgccttcagtaaggaattgttttcctctgggaaggaaatcactggcaataccaaatctataaggagtgccttagaaacttggctgcaccaagggccgtgtagttttgggaaaactcagcctgttttctttgtctctagacattttttagacttgataatccctcacatgggtgttggggtgtcttcaaggtctccaactctgtgctgtacttcgatcagcaaatgcttggggagaatttctgttttgattgcatctgccatttgcctccacaaattagacttttttaaataaaatgtaatccttttttgctgagacaaggatgaacacaatttattttgaaaagatacataaaatgtattataaaagacacaatgtgcaaaccagaaattgaaaactaaaaacgaacatcacctacacagaaaattctaagttcttaaaccagttggttgaacgaccttgggcaagttgtttaacttctttgaatcaatttcttctttatctgtaaaataaatacttataatcgtttcaagaaagtttattgactagaatccctggagccattcaaacagattcatattagccctcagcgtggctaatggcttcatctcaattctaagtgcggcacatactttcttgaaagtattgttaagtatttattttatagatgaaaactggttaaaaactacacagtagctgcatactgtaatggattctgaaaaggcctagttcaaactctgaccttctataaataacattgtggcctgccatatgaaaagacagtattgctagtgtcctgttgctgcatgggtgatgaaattaggacacggaccatgaatgagttgcctgattctgaatcagactatcaggcagtacagaaggatgccttcctctaagagttcattatttcctattagaatgctgtgtgtgctgcacatagaattgaggtggagcccttagccacactgatggctaatttgaacctgtttgaatggctccagggattccagccaataaacagaaacttgtctgttcatctgtacattcctctcaaattggttgaaataaatcctcaacacttgatgtttctgacctggttcacagatactcaggagcagcctgtggtatagcattatgagaaattttccagtctgttgagtagaagtaatccaatcctgtcactgtttgtggtagaaaggagagagaatatagagatgagatccaagaaaacaagaaaagttctgaggcctagaagaagtggaattctgtggcaaaaagtctggagaaactgaatttgagtttatggaaaaagccaaaagacagaacatcctggagaatagagccactctttgactggaagcttggaggatgattgtgagtagaatggcctatgtctaattctacatgcaggaggatggagcaggtggggccgtttcagggccaggaaagggtctcccttctactggactgggatgaaacaagagccaaggaacaaattgagttgcagtagcagatagaggaggtccagtctgagggtaaagcatggtgtccaagtagcattcagcaatggcagagcataaagtagatagttccaactggtagcccaagataaagaagcattcaaatgtatgcctgtggatggtgttcccttcccacaaggcacagaggattctgggtcaggcatcactcagagttccagagggaagggtatacatctgtcaatgcatagcaggtctcagttattcagcccaaagcaaaccattggctaaaacctttgataaaaagaaatgtgacatgtagcatggagggtggggcaagactgaggctcaggaatgggacagggcctgtcagaattaccagaagtgaggcagcaccacaagactagatcagcagcaagagttatttgaggtgcagtcacaaaaggtgagttagaatttaaatacatgccactttgggtctgatttggtcttaagtgtgtaggccaaggctcagtcttgaggtagagcatgatctcatttgtggtaagttgagagtatgctgaaattcagcatgaaaatggagatcagagatcctccaccttgctgtcagtctagacagagactgaaaaactgggttaaaactttaaagtctttatatcttggatatggagataaacaaggtaatactgcctggataaataggggaagaagctatcaaaatggtattgatctttccatttaagactatctattaccattcatctcttcaacatttgaaaagatgttcagtataacattgggattttaagtgatgattgtatcaaaaaatgataagtttaaaacattttaaacttatcagtgcacaagaacgggatgaatgcttatccagtatttctttctgtatttattatttgagtaaatcatgagtaataggttggtcccttatttaaaattttagttatggtcaattttaagaggaacacaataatctttttttttgtcttctgtacagttatatcaattttagcagtttggtgtctagttttaccaatgctattttatgatctttgccatttgccatggtacaatgtgtttaaatggcacatcaaggtatactgatggttgccatttgcttaataacttaaaagtaatccagcaatttcttccacttttatttcttaacatatgattttgttttgtgaaacatgaaagatgagtcttatatttaggaaccatttggttgggaagctgggagagtaaaatttaattgattttttttcttctgcagctcttgaagaaatagcatgtgaatccagattaggtggcatcatgtatatttttgtaaaaggaatttttacttgcttaggctgaattcatccttataagcctccctcagccatccttaattcctccctttctctcactcctgaagtcaaggattactatgttttattcctttttctgctgcaatatcccggactcttctctgtccatcactatagccacatcagctaataagctcctcttcctgtgtccttcttccctctctactcatcctctatagtgccatcaaagtcagagtattaataaacaaatcctgacatgtcagtgtgcttactccccacattttgaacggattaagttcaaatgcctcacaggatggcatttgaggtgctgatcctaatttatctttctaaccttgtttcttgcctctttcttccattcctcacatgcaaacactgaactccagtaacaccactttgtcttctcaacatactctgcactattgtgtcttcatgccccttggtacatgctatttcctctgcccagatattcttcctgggcttctgtacctgttgaccccttcaactcatcctttaaggactggttcaaagaccacttctgtgacatcatccctgattcccacagagttaaacaagacttctatgacacgccacagcatctgaaatacatctgtgctggaaacttctactatattgccttgtaatgatttgttagtgaacctctctcttccacttggtctgtagctccagaaaaccagtggctgtttgttgcctactcgtctttgctttattcttccttctgcctgtccacctgctctcccaacatccaggggccaggacagtccctggcacacaatgaacacccaacaaacacttggtttaagcaatgaattattatcttgcacgagatttcatgagtctctttagttttgctttcttaacttacttaatgcttattaagatgacttttcactttcagttcttcctgtttgattccagttcttagtcatgtcttccccttggcacaaaactgattgagcaatatatgctgaagcctcactcttcaaatttcatgacaaagtctgagggtcccaggactttggccaagcacaaatagtaagtgtctgggaggcatcaactaaattatctgccagtgaaaatgctctgtcttctttgtctcagttgtttatgcagaacaaccaaccgttcctgtaaagttatttttcctaatttttagcctaaacttttcaatagatacaggccatttctccctgtctcctcctatctcctcatcttctgagactgtaaattatcctgtaacttcatttataatgggaacatatttattttctgtgatgatggctcccctgagcctttctttttcttagctacataaagttaacttcctctgtggcaaattaaggacagattacaagcagcctgggaaccgggctccgtcaccacagggggccgcctactcagcctccttctgttcagccatgggaaagatgcagctgctaagccagccgggtgctgggctgctctccccctgcctctcctgatccctcggagggagttgagaagtccctttctccatcagtctctggttggtgtctgatgctctgttttctagcctctcttcttctgctcctcccctcccccagctgcctaccaactccttcccacccccaggccagcagtgactgcctccaagactccccctccttccagcaccgcctcatggtttccatggcaacagaaaatgttggtgggaagcaaaaatgctgaactgcaactcgtgttggggctgggaggaggaggtgaaatgtgggcctctctggaggctgtagaaaggtggggagaaagaagccaggtgagaagccctgagaagaaaggaccacgaggctcgaaaggaaggtgcattggcaagcggggatcactttgatcagaaaaatcagctaggaggaagaaataggaaagagttataaaaagtaatagagaatcctgggccgggtgaagtggctcacacctgtaatcccagaactttgggaggctgagatgagaggactgcttgagcccaggagtttgagaccggcttagacaacatagcgagaccttgtccccgccttcaaaaaaaaaaaaaagtaatgaagaatcctatatatagtggttgattgagggattacgttaggtataaaactgggaataggtgactttatattgaaggtgagtagtgaaagtcaacaaacatagtggccaaaaaaaggggggcttgagagtttaacaataatatacatacatgaaaaacaaaagtaatattaacagatctgggcttgtaaattaactattgtccttacttatcagccaagtgttacttatcttctctgagccttagtcttctttttgcttgtctattaatatagtgttatcaatatccacctcaaaaagttgttgtgaggatcaagtttaaataaagcacataaagtggccactcatatagcaggtaaggtaggaatttttcttttaaccattgtatgaggttgaggaatggtacttcaaatgggtcttggagctggaaacttaaaattcattgaaaactgtgccttgtcatatatttgatttttgtatttatttcaattttccatatctcttaagtatatggcaacatggtttttttttttcttttttttctttttctttctttctttttttttttttgagacagagtattgctctgtcgcccaggctggagtacagtggtgcgatctcggctcactgcaacctctgcctcccaggttcaagcaattcttccgcctcagcctcccaagtagctgggattacaggaacatgccaccacgcccagctatttttttgtatttttagtagagacagggtttcaccatgttggtcaggctggtctcaaactcctgacctcaggtgatccacctgcctcggcctcccaaagtgctgggattacaggcgtgagccaccatgcccagccagcatcatgtgactacgtccctaagtacatagtaccatggcaatatttagtgttaaccccttcataaaaaataagaagaaccatcctttccttttaaataacctccctgtctgtgcttttcaagaagcctgtggtgttgactcattctctctcctttacagccacaatattgttggcatcataacttctcatttcttttctctctcttcagtgaaaggggttgctgcagaaattatgttctaaacccacaatcatgtttataatggtccacgaatattttttgactgaatgtctgtgtcatcacttccttcagaagtccaaggcaagaaaagctaagaagttgtggcccaactagagatgcccataagcctatttactccgggctgtctctttgcaatcttagaagatgtcaagttactgcagaggctctacttcatgcctccttttcctgaaattgggacaataatagcaacgatgataactagcgcctgaacttgttgttccaaagtgcctgacatgaatggaatcatataaacttcaactcaacccaatggaattagcatgttgttaccgtgacggtttccacatgtggaaactgaagcacagagacattaagtaattttcttaaggtaatatacctcgtaagtttcagggctggaatttgaatctaggcagaatctacctccttaatcatctccactgtgctaccctctagggaagaaatatctggaactgtggcttgatgatattactactgctttttatagacaacgatttttttcctcacttggtatcatctaatgaataaagaaggaacgtgttactgtacttctatttcaagatgtgtactgagcccattggtttatcttttttctcctcttagatcccagtaaaaaaagctaaaaaaagaattcatgatctaacaataatgaggataattggagaaaagctatatggatctgggagatttcaataaatttccagaagtcagaaagagcgtggaaagatgatgcagtggggcagaggtagctttgggctagtgtgtttgcagagggtcctgaatcaaaaaaagagcccaagttgcccatcagaacctcggaagtttcagtctgagagaatggagatgggatggaggaggagatagagaagtgagtagaaaatgaggatgaatttaaaggtctgtgtattgaacagctgcccacctgcctgtaacacacatatccccaccccaatctctctttctctctctgtttctctctgtctctatccctttctgtctctctctctctctctcacacacacacacacacacacacacacacacacacacacacacacacacacacaccaggcatttaccctccattctcaggtcaaaaaggaagtaaggctaactctctaaagacattttaaaaagcctttctggggagagctggagcaactagtacagtggtgtttgggacaccctgatcattatagggacattctgctcaccacaacacaaaacctggaaattaaaaaaaaatgcacacagaatttccagtttgcttttccattgcctcttcctgaaatatgaacagaaaatcacaaactacagtcattagaggatagcttttagcacgagcgacaaagatcaaatgggaaataatgcacagcagaaaaactaactcaaaagacaattccaataatctcaatataaaaataactaacctctaactggtgtttctaacaggttcaaaacaatacatcagaggaaaaagaaaagggtgccaaaaaaggaatagagaaaaagagccttgagaaattgaaaatattattgccaaaattttaaaaatctatttaaacattgaaagcaatctcctagagtgtaagatgaaaatacaaagagttggtaaatgtgagcacaaggataaaagacatggaggaatgatggaagaaatccaacacctgcctaggaagatttcacaaaaaaggcaattgaaacgaagagatagatagaaatgatcaaagaaataatagaagggaatttcccaaaatgtacctttatatttaaagtgcctaccaagtgtggaacaggatgaaaaagacacccactcagtcacatcttagtgacacatcaggacactgaggataaagagaagatcctgaaacttccagagagggagaaaggtcaccgataaaagaaacaacgtcagactcctcatcaaacacatcaaacactgtaagacaagagagcattgtcttccatactcagaaaaattacatccggccttgaatgacatactaagccacgctattaatcaaccacaggggcagaatatgggcatttttagattcacaaagggttagaaattaatctttcatgtatttctcagctgtttcttttataaacagttatttgaatgtgtgctctggcaatatgaaaaatgacacagggaggaaagcatccaagaaacagtggattcaatggaggactgcaatgaagagagtcccaaaatgatgaatgtgtggcagtctcagagaacaggtccagcttcggacaggaagactaaggattaatgtgtggcagtctcagagaacagcccagcttcggacaggaagactaaggagatgggtcccaggaaaaatgtagatcagaaaaacagatagtatgatggagactatgaaaatcttaaggataaagtaaagataggaaatgcaagatgaaggaaaagtaatcagagatgacaggaaagattaaacagggttaaagattaaacaagattaaaaaaggtaagttctaggataactctaatgttcccagtaactgtgcaaatgggtgtaaccatcattatcatgggtgccctgcctctcaggacccaggtatggggttttcattcttgatacggcttcccacaccccacgagttggcatagaagcagagaaatactttcaggtcccaatgcaagcttggatgctgaggacttcagcagggaccaccatacagtacagatttccctgtgtgcctggcagcactaaggtctctagtattatggggtgacaacaggagaagccaatccagatggcaatggaatttcatgctggctttgccatggagtaaaaactaagttgacttgaaacacacacacaaaaaaattatattttgtcgcacttgaatttgtgggctaagattcagtttgcaactgtagtgtgggtagaggaattaggagagagaagagatgatagtattgacaatgtaaatcctcatctctcacatcagaatgtcagtaaataatatctaaagttgataaagccaaaattaagggcatttgcatgttatatggagataaccaccagaaggactaagcacagaaatattgaaagtatttgcttttggagagtggggctgggaacagggagaagaatgcaggaaatggtttgtattaaagttttatttgtatatttgtttgaatgcttgaaaattatatatgtattatttcattttttttaaagtgtgctcctttctgtcaattttactctccttgctacagtgtagttaagttgtccttggcatcattgttcctgtgtctatgtagaccacctgttttggaagaaggtgaggttatcaatcaaacggctaaccagtcacaggcatctactcattcacttgctaagctccttcctcattctcgtttccaagagtgctttcaaggacacaagagaagaccctatttagtgctgtcattgtcttggttgtgcggtaacaggaagcagagaagccttaatttttagcatctagacttcagctccaaatactgccattgaaatgggaagctctgattacagcttctaaagtgcactgttttctctgtgctacagaactgtcttctgaattagtatcaataaaacgctttctaacaggatctttgacaccagaagtcaccactgatgccaatgtaattaccatccctggacgctaggccttgtcaggcagcacagataatcacctacaaccaggggccaacgattacccagtcagtcaacgacattgactgctcactgggaggttctgcacgagtaagagagaggagaactgcaatgtcctttcctcaaagtacttcaaactaaacagggctgagggtgtggaggggaaggaaagcagagattcacacacatcaaaagacagaaataaacaaacctatccattctcagttacacagagagggctgtggagatctgagttggcgcagaataaaaatggacttttgcatcgcctggcccctgtttggtaaaaacctccttggttttatgtatttcctcttttcattttttttaaatggtgttatgtatttcctcttttcatttcttcccctgcccactaactgggctcaactactgaataacccctgtgtgccatgctttttctgtgcttccatactaattatatgctgttccgcttgcctgaaagctgttcctatcactcagccctttcagcttgcaaatttttctaatctatcaagaggtaaacctgacctcttctgtggagccttgcctgattcactccattttaattccaatcagttacagtgctgtgagctttgtgagaggagggacagagtatattatcatttgaaaataattaaaattgttaatagatgtaaaacacttagaatagtggtgcctgaaatgtaagcaaatgtgtttattattattattattagcatcattactatgatcaatgtttgtatttagaagccctagcataacatctggcatatgaaagtggaaactaagcaaatgtttctttgtttgaattcttggaacatttcagacaaactgagttttattgatgagaaggttgatgggttttcttggcagtggtcattattccaaggtgaaagtgaggattattgctttagctattgcaactgagaacacagaatatcttttaagaagcagaagctctaataggtgaataaatcattttggaggataggaggatattccagatgatatgaaactattgaaaacagatttgctgttggttttcagaaaatgtactagccctcaggaagatgggcttgtttggagagatacctaatgtaacacaaataacttcattttcttcagcattatctggaatagatggttaattagtctcagacagctgtttccatactcacccgcctttgctgtctgtgtgatgtgcacgtgtgtgctgtcatctgggtgagcctatctgggcacagtgacgggtcattaagctgtcttctcatatggtgcatgtatagtgtctgaagcacagtttcaggagacaggtaacacttccactcagagaggcattacatgacccctagggttgtcaatagatccgtagctcttttgctcttcaaacactacatgcattttgacatctcaccatctttgttcattgttccattcactgttatgtccttcaccccgttctttactgcttacataaatacactcaagcccacttcctccagagatttcaccatcactccagctcatagatatctcttccatctccatcatattcagcttgctttcttctttctttgtctctccctttctccctttctctctttctttttctttctctctcttttttctttttctctctgtctccctccctccctccctcaacctctctctctctatttttctgaaacagagtttcactcagtttcccaggctagaatgcagtggtgtgctcagagttcactgaagccttgaactcttgagcttaagcaatccttgcgcctcagcctctcaagctgctgggactataggccaccatgcccagctaatcaatctttctttctttctttctttttctctttgtttttctttccttccttccttctctttctttccttccttccttctctctttctttcttcttcctctctttcctttcctttcttccttctttcttctctttctctctctctccttctccccttctctcctttctctctttccctaccttccctccctccctccctccctccctccctccctccctcctttctttctttctttctttctttctttctttctttctttctttctttctttctttctttttctttctttctttctttcaagataggagtctcactgtgttgctcagactggtcttcaactcctggtctcaggcaatgctcctgattcagccttccaaactggctgggattacaggtgcaagccactgtgcgcagccagtcatagatttctaacactaatttctccaatagttacattttatattgtgaaaacacttacattgttggcttttattaacatttgaatgtgatttgctatttgctgttaagtatgctagtcttagctccctgagtagactgttggatctttaagcagatgctgtactatggctctttgtagtttctaccacatttagcacagttagatgagtatataggtacttaataggtgttcccttaggaatgaatggataaccctcctgggatccattcaaaaggattctcctgagaactccttaacaaaggcttatctactttctagtttagactgtcaacacatgctaaaggataaaagatgcagatttgaaacacatagatttacattttaaaatgctgtggcatatttgttaatatacttcacagtctgaatgcaagtttaggttagttacccttgaggacaaagctactagactctcgaggattcaaatagtctcataaaaatcatcacaatgttatcattggtagttaagggaacattttataataagtgggtgtctttgagcatgtttcctagggaaagtgctaagtgcaatctagtccatggaagtcccacagtactctgcgaacaacctgcactacttcatggccacttcacctgaatggctcagttctttgagtgtccatgtagtcaactaatcagtctgtggtgagtaagagtaaattaaggtgactaactttccaaagtcctttaaagttatttgatttaaggtcgctgagctaggtggtttatggatatttcagtattcctggaataattcatgtaagctttttccttgtatccaatatattatgagggtaagagcaatgaagccctgtgccaatttctccatttcactggctaatcagtaattctaacattgtttgccagctaaatggaacaggcactcttgtcaccatcatgattcattgcctactgaaagcacagagctggccttaatctaattcttaataaaaccttgcgaactaggtatactgtctcaatttgcacacggaaaacagatgttcacgaaggttgagggactggcccacgatctcacaccaagtaggtaaagaaccatggaagcaattctgtgccttaaagtgcaattgtctttctaattcctgtggagcatgattgtcttttccatgctgaatctaatgattacaaatatcaaatgagccctaagcatggccctgtaatcctactccattctcctagtaaactctccttcccactctctgaaacaactttttaatatcttctctatccttatatcttctacatccttacagcattattcactagaaaacagaaaccatcagaagaaacatatttccatattctcaatgcctcatataccagtcatgatggtacccactctctctgtcttccctcctgttatcacaggaatgtccccattagcaaccaactctccacttggctctggatcccaacctctctcatctttattctttccatccttctttcttttccaatatcaatacctctttttctacctaatcattcctttcagtagccaaacatgactccagtctctcctgttttaaaaaattcttccctttgccccacaagtcaccctttagctattagtgtatttccgtactcccattatcagaaaaacttcttttgacagttgtctactacttcttctatccaatgcaacatggcttccgtggctctcatttcacagaatgtgctcttgttaagttctccaggagcctctgtgttgccaaattcagtggctacttctctagtctcatttctttttttttttttcaccttcaacttttattttaagttcctagggtatatgtataggatgtgcaggtttgttacataggtaaatgtatgtcttggtggtttgctgcacagatcaaccaatcacccaggtattaagcccagcataccttaactattcttcctgatgctctccctcccccaacccccacccctgataggccccagtgtgtgttgttccccaccatgtgtccatgtgttctcatcattcagctcccatttataaatgagaacgggcagtgtttggttttctgttcctgtgttagtttgctgaggataatggcttccagctcaatccacatccctgcggagaacatgttatcataccttttcatggctgcatagtattctatggagtatatgtactacattttctttttccagtctatcattgataggcatttcggttgattctcatttgatctctcatcagcattctacctaactgataactttcccatggagcaagtttttcccatggagcaagctttcccatggagcaagcttttggtagcattctacctgataactttcccatggagcaagctttctaaacactttgagtttgaggggtcagtagaatatataggaggtagaaaactttgcttctgttgagtatcggtgaagtaacctaaggtgaaagtgcagagtgagaagagaagagactcaagggctaagcctgagggtacaggcggaagcagggagggctacaaggaagactgagaaggtaggaggagataacagagacaaggttagaagtcaaggacaaaaagagttgtcataaaaaaaaaaaagtggtcagaatcaaaggccagagaaagatcgggtaaacagggactagtaaaagtatattgtctttggcaattgagagtttattggttgccatttataaataatttcaggatgatgacagaggctgatggtattaaggcctgattgtatttttctgaagagcaaaccagcaagtgtaggcattattttgggaggcttggttatgaagggaagaagagtaagtggatagtgtctagagcagaataagaattgaggaaggttttgaaaaaaaatcaggttatatctgagtttgctcagagagggtagagaagaaggcttccctaatatcacagcattatgcaagaactaaaaatagaatctatttcttctgcctccaagataattgagataatacatgtgtaagagtttaaaaaactataaagtacaataagaatttgatatagtgttcttctttccactatattacaattaattaccaggaagtcaatggattgcatttttaactatataacacaccctttaccccactccctgcaacaagaacctcactgctatttattcagcagttcttaaatgattgatttgttgtggatgatcttttgcttgcttccttttgaaacagtgagggatttctggatgtttgccagcctgaatattcctgtttacttgtcttaggctaacagataactggatgggccatattgttatacaggcctgatgaatgccaaatgttcagctctatctctacaggattacacctttctgaaaaaagaatgtataatataacttctgtcaaataaacttgagatacatttgtttctagtcctcagatttcaagatctcccttaagactttggaaggacaagcctaattctctttgccaggcatgaaaccagacattagcttataaactcaagatgttccataattctttcaatatgaattctaattatctttgctccttctaagagaaggtaaaagtataacaatgtgaaatctaattctatggactcaaggggcagaaatcagtgacctgatattcagaggcctatattaattatccattttatttttctcacctctgtaatttgtaagtagagttgcaagggctcttgttcttcagttactattttagatcatacactctcaaatgaatggatagttctcaatgcctgcgatgcgcttgattcacacagactagcctaggttgtctgaaatgaagtcagggagacgcatgcaatgacctgtaaggtgttgtttctgtgtctttgtagcctgagttttcttgtggataaaaatctatagccttttattatgacagctcattacaccacagaaaaaactaaactgaaagatagatcatgtcttccatgatcactgctactgtttgatgtggtgtctcctgcatgaatgaaatgactgccactcagaaggtctcatggtctgagaacaaacttgacctggaaattcatctgtatttttacaaccctgtgtatggtgagaaagtttccttagtctagactgcttaatatctgtataaggccatttttttcttctctctcacctctcttgttgatactcctctgaatcatcatccacccaagatcaaggaatgctcacgctacttttgtttgtccagggctcagatctttctcagctcactcagatatgttgccccagtatctcttattgaaaacttttccctatggactcagattgacctcagtttaaatcttcagtgctttggaccatatatttagtctttctataactaagttttgcccttgtaaaactggaataatactacatactgtgtaacatttgtgagggggtaaagataatgtatgtgataatcatataacaagttcttgataaacaatagttatattattaaattggctatattttttttctttctataaaacattacttgcctaatcatcaatttccttggagtgcttctatcaggtagttatcaagtgtaaggatggaacccaaataaatatttcttgtaagtgtgatttatttaggtactggaagaggctgcaaaataaaatggaaagagtgtagggctagaaaggtgacaagttcctggttctggtgttgccagttctcatattaaatagcagtgttatctgtatatgattacccatctatgaaaaactctaagttattagaaagattgaattcatcattgatgaaagagatccttcaggcatctggaatcttatgtaaacctcacgtagactgagtttaattcaattaaataactatttattgaatgatcattatggactgtgcttggcaatgtgggggataataaacaaaggctacacatatacacacatttattgagaactgttatgagttgaattgtgtcaccccaaatttatatgttggagttctaacccctagtagatatgtggatatagatacacatcctagtagatatagtaggatgtggccttatttggagatagggtctttacagacataatcaagttaaaatgaggtcattagggtgggccctaatcaaatatgactggtgcatattcgacatgcacagaggaagagatttgaaacacaaggagaaggtgaccaaggagataggtccagaatggctccttcccttatagccctcagaggaaccaaccctgctggcactttggtctcagacttctggcctccagaactgtgagacaataaatttctcttgtttcagccacctagtttgtggttctttgttgtggcagccatagcaaactgatatgaagacctactatgtgctagtaactgggaaactaacactgaacagggcactgttatttgtttcaggggaagaagtttggaaaagaagcagatacttcagtcccatgtaataaacctgctccaagagaagtatgtacaaggtgtcatgggaggacagtgaaggacagttgagtattaccaaaggcttgtttaaggctcctcagcagggacttctaagccaggcctttgaagtaagagtgcaagaatgagtgcaagaagcaagagttctgggcagaaaacagtgtttatatgaggcagtgtatgcaaaggcacagatatctgagcaggtgtggcactgttgtagaactgtaagtaatccaacatggccagagcttaagagcagtgaaagataaggctggagaggtgagcaagttccaggtcagtagcggaaggctccctggagcaaggggagcacctagaaccttgaggtaggtcttccttgattagcaatcgcgaggacataggctatgttaggtaggagggaaactgtaaacaaaagtgaatgcgtatatttatttggcagtgagcattctggtctggttaaagcagacatcctcttgacaagcagagcaagcaagtgagaagctaagaggtaagataaagtctctcaaaggaccagaagtatgacaaacggagtgctttgagggcagggctagtatcttgtttagtgcttgcagtatagcagtggctcaagaaacaatcactgaataagtgaagggagaagtggtgaaattctgtccttttactgaattaagcagggacttttaggttacagaggtttggttttgaaatctaggctctgctggcaatttttttaaccttgttgagtttcatcctctttatttctaattgtgagtatactaatattgaccgtattggtgagaattatatgggataatttatatggaactatatagaattatgggtatactaatacttagcatgggataatttatatggaattttatagaatatatggaactatatagaattatatgaaactatatagaattatgggtatactaatgcttacagtatatggtgagaattatatgggataatttacatggaaatatatagaacttaaaaattccatttgatcaatatttattaagaagctactatatgccaagccctgtggtaggctttaggactagaaagatgaacaagacccaatctctgcctctaaggaatttactttctgttagggggatggggaagcagacatctgaatagataaaagaactgtgatgcaatagaataaggactagcttagggctaagaacagagcaccgtgggtgcacagaggagggacagttacgccagccagacggcaggatagtgttggggaatacttcctgggggaagtgatgcttaagctgattcatgaacaatgatacgcaattaggtgaagaaggaagaaaaaggaattccaaacagagggaacaacaggcttcctttgcagctgtgtttttctagttcctgtgcctgtgcaattccttgctgaaaatatactctagtcggcttggttaaagcaaaaacaccctctctagctctcgtcagactcctgaaggttggatcgtgctctgaacagcctcagctattggctggcttctctttaaactaaacaggccttcagaaacccttcatgtagccacctgcctgatctcctcactccctttctcctgctttctttcttttcttcctgtccttcctcggtatctgctttcttcctcctctcattaaacatttcctatgtctacatgtgtaaactatgggctgtgcctggagatacaggggataaaagcatacatctaactcatgaggagctcgaaactgaaagtagggtcagcgagctatggcccattgaccagatccgcctgtttttgtaaataaagttttattggaacatgcccacgcccatttatctatgtactggctatggctgctttcatgctacaatagctgtgttgtgtagttgcaatagagaccatgtggcttgcaaagcctaaaatatttaccatctggccctttacagaaaaagtttgctggcccctgttctagtgtttatatatggcagaagtggtggggatagatggacaagtaaagaggtaatgtacccctgtaagataagtttttcaaaagggtactatagaaggagagttcctaacccatacttggagattgagaaaagaactgagagctaaaaaaagtgacaagtacgcttagagctaaaggataaaaaggagttaagagggaaaggaagatcattcttggcagagacagtagcatgtgcaaagccaggcaatgaaagaaaaacatgcagttctctattgcaaaaagaggaagcggtgaaagataaggcaggaaaatcagtttgggccaggtcattaaggatcctaaatatgaaaaccatattaaggattttagaaatgccctataatctctcccataggtaactgagaacctttgaaggattttaagcagagtagtgctaaagcaaatgtgtgctctagaaagatcactctggctgtaggatagttaacatttactgggcatttattctatgccaggtctgtgctaaacgctctttgcatttggaaatatctattgagtagctggacagcactgggaaccaggtagaaagaggtgaaacatggagaacagatatggatctatgagaaccagggatctccctaagggatgaaaaggtgtagagcaccacccttatttggaggcatgaggagaagtagaagaacaggggtgattgcaaaggggagtatactgtcatggaacacaaacggggagtaaataacaaggaggagtggatagtgaaaatcagatattgtaaagagagctaagagaagaaaagtggaagaacaagcagggggcagggaactggtaagaagcagatcagagctgacttaaaagagagcaatttcagcagaaaagttgagaaacaagctggattatagggttaaggaagtggttggaagtgagaaaatggaggtcactgccactgaacacttgtttgagagatttgtctttttaaagaagagtagaaatatgactgtggctggatttcttaaaattaggctgtaattcagcagctttggtaacttttctgattcatgaggtaaatttctcatctcaaatatctggtcatttgaagtaatactggagatcaaattacgcaaatatgctgcatgactaaattaaaggcctattcatgtgagcattagttagtaatgggagttgtattatatactgcattattagaaaatggggcagcatattttaatgcttaaaaatttaatcagagcaacttccagaaggaggaaaaggctcctttttaacacaagatttgaatcatggcaatttttttttttttctgaaagccattcttctaagatggtcatccctgcacatgccctcatttctgactttctgctgcacaagcaatcagtattcgtgcaaggctaatgggatatacaagaacaattagtagctctgccagcgccaatattgtacttgcctctttaaagagctcaaaatattaaataacaattggaaagaacatttcttctagactactcattagattgattttacagatgagtaaactgaatcatagagaaacaagatagtggaaatgagaagtcttactttggttctatctcacaccactgtaaggctgtgcctattatatctgtaattaagctgttgtccagataaacaataattcctgcttggctttgacttttagataccaacagatatttaaatgccggcagttgaaaaggttatttttttttctttcaaaagtgggtttgtaactattggcttaaattattttagaaaactatagctgtactttcaacataaggccacccactcaactctgagcctagactgtttgagaaataagaaggtataggaaatttggcaggtatttttctcttgtatctttaaatctcagtaagttcacaaaattttcctaaccaatattggaacaagaaattatcacggggggaggggggtgactaatctcaccttttaaggacaattaatttttctacttcacaagtttaacttcttatttggatcacaatatgctactaagatacttaaaaggtcattttttcaggccaactgcaaatgatgttttcattatagaaaagttatgtaaaagtggaaaagagatgtaagtccattaacgtgtaaaatgcaccatagcaatgggaaaaaagttttaatgaaatacgtatgagctctatcatgcgcaaatgttttgttgaaatggatgactccaagagctctgtggttccacttcagtgtctaataggcactactcactttaaccttcagcaagccctttatgaatgctatccacccaagtgtatgaaaatgccaattcatgtagggctatcagtattattgttatttcttattctgtaaaggctgcattttgaacattttaataagggtcaaagcattccaagtcaatctagatggcaattgttagaaatgcaggaggtgctttaaaaaatgagttggtaataatttcattcttctcccattttgattagtttataaatataactgtcagctagttatcatggtgaggttattggtcagtcctcctccaagtaatataaactccttaatacagtcttcagactatgaatctaccataacattgccagtgttttgatatcatcagtatcttcatcttcctttatttcaagctatgatagattttacctcttctattatctactgtaatttgctgctgacacaccaattgctagtaaatacatatgttgagcgatggtgattatgtgaagaatgaggggcaagatccctgtggtgtagtgtgtgtgcacccatgtgtgcatgaagaaacgtgtgtatgtgtgatgtgcatgcaaataatataggtctgagggaaatactgtactccccttgaaggtaagggtcatgtcttattcactgttacatccctagtacttaacactgtctctggcacagaaatgatatctaaggagtgcttgctgcatgaatgagtgaagggtactaatggtccatgttcccattggcaaaataaggcttccagtttaaaaatgagactggaggtccacctacaacaatctgttgtgctttcagtttttacaggctgatttctacgcacacagcattatgctgggacttgtgaggaaagcaaggaaactgaatacacagaacttggacttgagaagctttcagtctaattggggagacaagatacatacaagtgaaaacttaactcctaattctagagagagaatcatggcatgccaaatgtatttttttcatgtcaaatgtaaccactgcgtgagttcaggagaaaagagcctgttctgtactgcagccattaaagaaagctacctaaactaggcaagaattgagttatacctttgaggataaaagacagcagggaaggaaaggaaatgtctgtccaggaggagcgggtagagaatacagatgagcaaagttattaagataagaatagattctttgggacttaaaatttaggaagcagtcattagactttgaaaaataaatatgatggtagagacaaatataacaaggaaataaataagcatgcacattttgtatagtaatcacttcatacctaaactccttggtgaaaaaaaatgtcgaaacttagacacattctctatgttgcaaactcaggggaagtgagtgaaatgtcagaaggcatggcagcattcccagaggttagtgagtatcaggtaggctttgccaagcaggagggaggtgatgatatttgacttctgaggggataaacaggtaaggtgggatctgggcagattttcagacaaaagattctgttgtgaaggggcttctggttttaacatagatgtgactctccttaagtcttaggtgacctgatgtacttctgaaactattcattgattgtacaaatttctatttattttacatttttaagggcacagaaggatctaaactatgtgcacaactattctacaaaccaaactgaaaatcaaaatgaaatacacaaaggaaaagttgtttgaaattttgtctttaagatacagggaaaaaatcacacatcagtaaaatcaaggataaatatcagcctgaaggaggagcaataattgacaaatatttaaaaacaattgggggccaggtgtggtggctcatgcctgtaatctcagcactttgggaggccaaggcaggcggatcatttaagatcaggagttctagaccagcctggtcgacatggtgaaaccctgtctctactaaaattacaaaaattagccgggtgtggtggtgcacacctgtaatcccagctacttgggaggctgaagcaggagaatcgcttgaactggaaagatggaggctgcagggggctgagatcacaccactgcattccagcctgggtaacaaagtgagactcccactcaaaaaaaaaaaaaaccaaaaacaaaaaacaactggggtctttcttttctaaccatatctagacattggtgaaaatagtccttattaaagataataatagctatggagataaatcatccaagtgttgcatttatgtgtgagagtatgtatgtagaacagatttagcaaataatttttaaagctttcaataaatactttaagtgacttatatggacactttaaatgcacattcattaatggattcttgattgaataaaaaattaactcctgaaaatatttcctaaataaagtacatctatgcatggatgcactatgatgtttcaaccaacattaattatacccttttgatttctactgtcttgttcaaaaacactaataagacatgcactacatcatagttaataggagtgtggtgcttgttgcttaggcaacaggaggaataaatgcaggtcagaatgtgcttcaagaaaaacaaaagctagaatatgatactgagtggagactaagcaagtctaacagatttttcaccacattaaagaaatatgtttcttagagcaagccaatcatattcatgtgtttaactaagtttgcaattacataaattagattatgtagatcaataaataatttttataaaggtagaaattaatcgcttatgatactagtagcaaataaatggtgtataacagcatgtaaagcactaattgattataccacttcatgatttgcttcattttcataattaattaactcctctaaatggcaattcaaagtttttttaaaagataattctgtctcatgaagaaagtatttgattggcccatctaagttaataatattttcttattttctagaaaattataccaaatactttgaattaaacaagtaaagaatataatctatgattagaccttggttacatcatgtatatccaggattttgccttccatataaattttgaagtgcttatacatgattcattcatgaataatttttacgatctctctttgaatgcttatttgaaacctgtttgattaacctttcagttcgaggctttcaaaaaggtattatatttgctcataagtgtttaacattcagaggaaaaataagctgaattaaagtctttcagcttggccaaatgatccaggaaatccaaagacctaacttctcatgggaccagaataaatttggacaagggtttcagggttgggaatgagaaacccttatttcaagtagacatagggagaaataattaagatattgaaatgtacagtaaacataaataataaaaaaagacttcaattctgtttgatagttcttctaattcttaatgccatctgtttagtgtcctaagtctgtcctaaatctgcccagtgttctaagactttcatagcaattgaagaactttcacttttttccatttcaatacccaaatatcttgtctatataaccagtgacagtacttgataaacacaagaaaaataacagtagctgcatatatcagtataaaaaaaccaacaaatcactcataaagcattctgtgcatgcaattacttagagctcatatatcttactatatttatgtcttttttatttttaaaaactcttgggcatacatacttttggagaaggagcagaagttgaataatgttaataatcttcaaatctataatattcaagtcaacctcagagaaaaataatctaagatagaaattaaaaaatctaatcagctgtcactattgtgttatcatttctggtactagtaagctgcaggtgtcagccctattactgtatttaggcagggctattacttatttccacaagtcatttgtgtgttacatgcctgtgttatgtaggtctctctaaacttagggatcagtgatatgtgtgatgggtacttaaaagcaaggaaaggtaatagagctgtgacgtagcttaacaaggggaactgatgagcactgggggaggtatgggaatgattagaaagctgaattgtcggtttgcacagttccccatcctccttcctcacctatatgcaaaacggtggaaagttagcacatgccaggtttagattgcatgtagaccagaattcagaagtacatgactatacttactccaccaacctttctttctaaatattgacagctaaatgaccaaagtgtttattttccacctaaagtaataaacaatacttcatcgctcttcaatcagcaagtggaagtaaacgctctccataattgaccatctgaagcagtttgctaatgaactgaaggttgtccacatgatttaaactgcttattgaacaattatcaggaaaagaaatgatcttcacaccataaacacaacaaattgtctcattaaccactaaatgctgatgctcaagtgaaataatataagaatcaagaattagctgaagagtgatataatccgagtattctaagattacaaatttatttaaaaaatcataccaagaatgacagggagaatatcaatattaatcttctttcactgcctataaatagcactctcaccagttcattcatataacacatatgtatatggatacatacagatctcattttttagcaagagtctatatgtacacagcaagttcagtcctaagggcatccaattttccaatgcagttacatatataaatctgaccagttttggtgcaaatcaggctgcctctgagccatgtaagacacataagaagcaaagacagacaaaaggcagctccgtggacacagagagcttcttaccataaactgcacattgtcaaatccattagccatcaggtggttctcgtactgaggtagcccaatgctttccaaccattgtcccactgtttggacagggcatctgggtcctgtaagaggatgaagagggaagcgtttaagcagggagtagccgtccacggggtaatagcggtagtcctgggctgagaggtggcattgccacatcatgcccctgggaaagttgctatcaaaggagcccgccagcttgacagattaatgttctcagcgagagagcaaagtcagaagtaaaacatagtttgccaggcaggctgtggagtatgacttgatcctagctccacatttcttacatattaatctttactaccgaccagtacgtcatacagcccccaaaaccaggcagcagaagaaggcatatcaagctgtcagcttgggctggtctgcgttctatgtgattgttggagtactccacaatgagcaatgcacggccggcagccagaattcttttttatcaagtactcctacactcatcagtatgcagctccatgctccttgctccccctcgctcgctccccttcattacccagcccaggctacacctcgcattttcaataatagccatcagataaggcagattttttttgtctgcaagctgtaagcctgctgctgctgcttcctcctacacacccatccaagcgtcaatcttgaatgatgagagcagtcaaaacaaatgcagaaaatagcaagattcaaaagcaaaccaaagtgcttaaatctgaattgaatcttcatactggttatacgttacagagctatttgttgtggaattttacgtttcaaaagacaccaggaaatgcgaagcttgaactatagcttataacagagctcacgacaggttccctttctccttttcctttctttcctgtcttttcttcttcctttttaaatggagcacagataaacgtttctgatctgaagctttgcagtgtttggagaataattattctgtttctttaccatgctatagcaaaataagcctctccgagatatatatttttttcttttttgaaatactgcaaaatacagaaactgcatcgcaatcttgaagtcaagataatttatttcttgtttgcatggtttcttccaaacaaaagtattattaggcacaagaaatcctttttcccctctgatatttataacccaatctaccagggttaccattctaaattagctataaaggtaacattaactggatagattttttttttaataaagaagatgagccctaacccaaaataattcaagaataacagatgtaaatgtgtgagttttactgaatggcagatagactgagtaatttatttaataattgggagaaaccagggattaagaatagaacccacaggactagatcatcagaagaaacagactcttaagattgggagagaacttgcagaaaggttagtctaaccttcttcctaacgtaggcatccctggctaaaatgttcctagaggaatatcttccaacttctacttgaatactgcctgtaacagagctcttactacttctcacgaagcctcaatttattagaaagatatttcacttcctaccttgcttctactcactgctccagctctgccttcggagaagcacagattgagaacagtgcctcttccacataaagagctttaaaatttaaagataactctctcatccccccagagcagccgcctggcacatagtaagtgcctaatacaaatttattgaataaatgaaacatcgcttttcttttttcctcaaacctcatctttctctgtttcctttctctttttaagggcattgtcaactttcctggcacacagacattaaacctcaaaacatcttctactcctctttcactactgaaatcagtccccaaattctatcatccctcttcccagtgtgatccattcccttgattctatttcctgttttaagtttacagaactgccacctacattgattttgttctcatagttcaggcccacctagcctagtgaaacaacgacttctatattgatctttctacctctaatatttaaaaaatcaattttatgcatggtgtcagaataatccctttaagacacagttttgattactactccctgtctcaaaacccttctgtggttttctgttgtcttcaaaatcaactcccaactcctctgatgacattttggggtcttcatgattgactgcagttcatctaactttatttccacttttccactgccccagacaggcaggattacttgctggtctctaaaggcagcccataatgggctttggttggttttattatgtccccacatttctgtccatttgttggctttgaatcagttgctatttccattatgaaacctcttctaatcttctctaccacgaataaatctctttcttctctgtcttaaatggcatttttagaccctctattgtaacagatattttctgccttcaattttagttgtttgtgtctgacttattttttgaaagcaggcaatatgctttgctaatatttcacatagtaaagattcagtacatacctgctaaacaaaataatgtaatttcatgatccaaagtacaaaaaattctattttcaaatttaaaaaaagttttaactctatcccaagtctctaaattatttatttaaaataagataacttgttttttaaacagattttttcatgtctgtcttttagctcatcatcctcatccactttttgaataagcagccctgggtggactgcatagtacttgattatattttgttgctgattggtcctggatcttttaataacatcaaagagtttgtagtagtttatgaatcaattttaatagattctagttgctcaacattacctataggagaagctaaaaacaagatactatttgtccctggccagctctaaagctgttacaaggtggaagaaaaggaaagtctcaattatagcttctcctaggatcacagccacagtgcttcacctggtcattttgaattataaatagttgaatatactacatggaaattgagcaaacacgacaatgacactttggcttggcaaggcacatgctgattggccagctcttcaaacctgtttcatctgttaaaatgcaaaccaggggccaagtacctggcagagcacgatacacatcctgcttattaaataaactttgttaaataaatgcctgagtaactaaatgaataaatgatattggaaatgcctttcttgagattctcatttcttagtacagagagagggaaagagggagagggaagaaaaaatgtgtgtgtgcacaaaacatagagagtggactaatagacactggagactcagaaagggggagggtgggagaagagtgagggatgggagattacataatgggtacagtgtacactatttgggtggtgggtacactaaaagcccagacctcaccactttggatatatccatgtaacaaatctgcacttgtacctcttagagcaataaaaataaataaaattatatattacaaaagacagtatatttgtggtggggattatttcaaggttcagactgctatataagaacacaactcagagaaaatactggttatgaactactttacaaaatttatatagactgcctgaattttattcttttaggtattcaatccttcaatttttattcaataatttttacatgttgacaaaatgttataatatatggaggaagtgagctgggagaggatggggtgaggaaggtataaaagagagggaagaaggaaaaaaaagaagaccctgagtcatgttgtttgtttgcggttttgttgaagtattttctcatgagtcaaatctctaaaagaatcttggttcaggtctgaagatcactctgtaacagtgcttaaatatattactctctttacctaaaatacttttatggagtcttaaaattcttaaagcataacaacacactaattaggcaggaacttttattcaactagaatgtctttaagttccaaaagtgagacaagaggagggaaagaagaaactgaccattattctgggctaccatgtcctaggcagtgtggtgtgaattattatcctgatttaccgtaaggaaactgaagctcagagtatgtggtgaaaacaggaattttctttgtcatagtcttttaaaaaataataattctaggggttttactcccataatggcagtgtgaggagctccacaggtccaagccccagtcaaaaaacttaacttgaaaattataaacaaacaatcaaaaaaccctacacaatcagaaaccaaaaacaatgccaacaaaaaccaaccatcaaagtctttgcaaagtgtcctaagagcatataatgtaaaaatgtttattccaaagacagacactaaaacttggtaaaaacagattctgagattctgtagcacttgagccatagctccctctggcccctccttccctgcaactcatctccatagatgctccactttggatggatgtgtccaagagaaagggctccccttctcctcaaatcccaaccaagcggcatgggatctcatcaaaaggagcaggccagcatttccaatttcctctaaatctaagctgtagaggttcaattcctggtgagtgtggctgagaggtcaggggctcctttcttccacccagaccccattcatagaatagaaagttcatcccagctgggtcaggccaaaaatactgggatcttcactgccctcgactgcttacatatagggtagaggttccatgcccagaaaggtaaactaggaagaccagaggctatcattcttgccccatgcctggaagagtggctcaacgattttgcttaaagggagagtcagtttataagaacaaaaagctctaaagctttcccccaagaggttgacttatttgtttgttttcaatttttgttttggatttagggagtatatgttcaggtttgccacgtgcgtatattgtgtgatgttaaggtttggggcatgaatgatcccgtcaccaggtactcagcacagtacccaatagttagtttttcatacattgtccccctccatccttccctactccagtagtccccactttctattgatgtcttcttcatgcccatgaatacccaatatttagctcccacttataagtgagaacatacagtacttggttttctgttcctgcattaatttccttagaataatggtctccagctgcatctatgttgctgcaaaggatataattttttttctttttttatggatgcatagtattcaatggtatatatgtaccatgttttctttacccaattcaccattgatgagtactcaggttgatgccgtgtctttgttattgtgaatagtgctgcgatgaacatatgagcacagatacctttttggtagaatgatttattttcttttggatatagacccagtaatgggactgctgggtcaaatggtagtttgttttaagttctttgagaaatctccaaactgctttccacagagtctgaactaagtgacattcccatcaacagtgtataagtgtccctttcttctgtagcctcaccagcagctattattatgcctcttagtaatagccattctgactggtgagaaatggtatctcattgtggttttgatttgcacttctccgatgatcagtgacgttaagcattgtttcgtatgtttgttggccacttgtatgtcttcttttgcgaagtgtctgttcatgtcttttgcccatttttaatgtggttatttatttttatttgttcaattgtttaagttccttatagattctggatattagatgtttgttggaagcatagtttgtaaatattttctcccattctgtaggttatctttttactctgttgataatttcttttgctgtgcagaagctctttaatttaattaggtcccacttatcaatttttgtttttgttgcaattgcttttgaggatttagtcataaattcttccctaaggctgatgtccagaatggtgttttctaggttttcttctaggattctttttttttttgagatggagtcttgctctgtcacccacgctggagtgcagtggtgctatctcagctcactgcaatctccgcctcctgggttcatgccattctcctacctcagcctcccgagtagctggaactacaggcacccaccaccacaccaggctatttttttttttttttttgtatttttagtagagatggggtttcaccatgttagccaggatggtctcgatctcctgacctcatgatctgcctgcctcggcctcccaaagtgctgggattacaggcatgagccaccacgcccagcctcttctaggattcttatagtttgaggtcttactttaaatcttgaatccatcttgaggtaagttttgtatatggtcaaaggtaggggtccagtttcattcttctgcatatcgcaagccagctatcccagcataatttgttgcatagggagtcctttcctcattgcttatttttgttgatttgtcaaatatcaggtggctgtaggtgtgcggctttatatctgggtcctctattctcttccataggtctatgcatctgtgtttgtaccagtaccatgctattttgtttattgtagccttatagcatagtttgaagtcagggaatgcgatgcctctggctttgttctttttgtttaggattgctttggctattcaggatctttttggttcaacatgaattttagaaaagttttttctagttctgtgaaaatggtagtttgataggaatagcactgaatctgtagattgctttgggaagtatggccattttaaccatattgattctttcaatccatgagcacagaatgtttttccatttttttgtgaaactgaggttatttgacacagagtgtgcggaagtttaagcctaaacgtgttatcaaaatcaatggaggttacacagtggctcattcctgtaatcccagcaatttgggaggctgaggtgagaggatcacttgagtttgagaccagcttgggcaacatagcaagccctctatctctacgaacaattaaaaagtagccagagatgatggcatgtgcctatcatcccagctactcgggaggctgagatgggaggaccccaaggctgcagtgagctatgattgcaccactgcactccatcctgggtaacagagcaagaccctgtctgtaaaaaaacaaaccaaaccaaaacaaaaaaatcccccccaaaacccagtggagatattctggtgacaaacaatcaaaaagtggctaatagctacagtagggaaataagctaaatggtaggttagctagttttaaagaaacagagaaagacagttatgaagagccctgttgaggtcaaaagaaacttcaaatactagcttcaaaaattcctccttctcaaatttaattggagcagactctggagcaatttatagctgacggattgtcaaaaacaatagagcaatcagcaggcaattactggagtctaatatctggatgtgatatcaaatgagatagacaacagaaagattaggaaaagagacaaagagagccctgctataaccactgccatcccaaaactgtgcagatggccaaggctacacccttgagaggataaatacaacgtgatgcatccatactattgactattacttgacaataaaaataaatgaagtgctgatatatgctgcaaattgcatgaaccttgaaaacatcatgccaagtgaaaaaaaaaagctagttataaaagaccatatattgtataattctgtttaaataaaaggtcaagaatagacaaatctatagagacagaatgtagattaggggtttcctagggctggagaagtgaactgtggaaagtgactattaatggatttagggtttctttttagagtgacgaaaatgttttaaaattgtgatgatggttgcacaactctgtgactacactaaaaacaactgaattgtaccttttaaatcagttacttaaattatatatatgtatttatatagtatatcagtagatttaaaattattgaatgatgatataaaataataaaaacaaatcttaaaatttctttaaatttacaagaacaaaatgcacatacataattgtatataaaacattggggttgtttaatatatattggtagttttagtgctctgggttttttttcttctttagttttcttggttaccccttcctccattcttgtcctgcaatctgcatcatccatcctccctgcaaggttattcatgttaataaactggtatgtatattcatatatatttacccattttcaaataacacacacacacacacaaaggcagatatgttcggatatatacgtatatgggagagtatttttggcatggtttcatcaaaatgaaattataccactcacttttctgaaccttagtttgctcatttaacatcttataaaaattctactggccgggcgtggtggctcacgcctaatctcagcactctgggaggccgaggcaggtggatcacaaggtcaggagtttgagaccagcctggccaatatggtaaaacctcgtctctactacaaatacaaaaattagccggacatggtggcaggcacctgtagtcccagctactctggaggctgagggagaagaatcacttgaacccaggaggtggaggttgcagtgagccaagattgtgccactgcactccagcctgggcgacagagcgagactctgtcaaaaaaaaaaaaaattctactaagtaaatgagttttaatttattatttgttggttatttgtaaaaagttaaaatagttatttttagttattttcaactttttaaaaataactacataatagttcataatgtggataaaccacagtttattcagttctttgcctgatatctctaggatatctttgcctgatatacatccttttattttctttttttaaagatttttattttgaaataattgtcaatttgcatgaaatgatagagagagtgattctggatagattttcttcagttttctccagttgtgacatcctgtatgactttagcacagtatcacaatatcacagccaggtcattggcactgaaaaaaatccactgaccctgtttatatgtcctgtgttttacatgcactctgtgtgtgtgtgtgtgtgtgtgtgtgtgtgtgtgtgtttagttctgtacaattttatcacacgtgcagaccacgtggccatcatcacagtcgagacaccgacagcaccatcataagaatccctcctggaacttttttttatggccatagccttcttcctccctttcccattttttgacccctggcaactactgatctgtgtccatctctatcattttatcatttcaagaatgttacatgaataaaatcatatattatgtaacattttggaattgggatttttcattcagcagaattcctctgaaatccatacaaattattcagtgtgtcagtagcttattttttcatttctgagtagtattccatgatatggatgtaccgcaccatttacccattctcttccagagtggctgtaccattttacattcccattaatagtatacaaatgatgcagtttctttgcatcttcactagcatttggtgttgtcaatttttttatgtagtcattctgataggtatgtactaatatttccttgcggttttaatttgtatttccctcatggcttactatgttgaacaaaatcttattgcctgtatctttttgttaaaacgtctgttcatgtcttttgctgttttcttcattggattgtttttctactgttgagttttgagaattctttacatagtctagatactaggaatttgttggactttttatcaatttttttatggatcatgtttttggtgtctatcccattatttttaactttaaaaaatgagcatttaaaaatgtgtctcataaatagcccagagctgtaatattttaatctgaagttttaaaatacaatctctaatggcttacattttaatgggcaaatacaatttggagtaatgacaatcatgcttgattttatccattccatcttatgttcttatttatttacattgttgtttcctcattttccttttcttcatttttggtactctggtaacattcttattcattctatttttctctttttaactttgtgactctgagatacttctctattcctttcaaggttactttatttttccctgctctaatgatcagatatatacttttctatgattatttgaaaataagttaccaattatttccctctcaaaaacgctctatatccttcatactccagtaaaattagaccctcagaatgttttcctttcttcgttctctttttcctacaaccacatgtgatctctggaatgcttttcctttacccatctgccttattcccaaccagttcctaggttttgctgataatcatttagtaaacattttcctagtcaattactagaatttcctcacagtatattcctcctatttaaagagtctttatttaatatttatgttgcacactcccagttggtttatacatttcagtttagatttaattattgtaaagattcattggtcaccactatttcatatccttataaccatcttaatcttgaggtttctgtttccatttgtttgtagtttagttagaatagtttctcatatattcagaaaatattttaaactgattaatcataaaagcagagtgaatcacaatttgtgagatgcaggtaaaatggtacttggagataaatgtatagcactaaatgcctatattagacaggcagaaatactcaccactatactagtaaggaacaatgtctaccttagaaatgacaagaatttcaaatcatttatctcagaattcactttaagaaatgaaagtaagaagaaagataactccaacaaaaataagcagaagtaaggaaataaagatcagaggggaaataaatgaaacaaaagatcaatagagaaaaatcaatgaaaccaaaagctgttttttgagatgattagtccaactggtaaatctctattcaggctgaccaggaagtaaaggagaataaagaagtaatcaataccgggaatgagagaagtgacagcaaaagagtttttatggatataaaaagaataaagaaatgttatgaataactgttagtatcagtaaattcagcaacttagatgaaatgacaaattcattaagagaagcaaggtaccaaacctcactcatgaagaaaagttcataactgactagctctctacctattgaagtaattgtatttgcagttaaaatctttatacaaaacaaaacaaaactccaggcctcaatggctctagtgttaaattctaccaaacatatagtgaaagaaataatagcaattctacacaaactcttccagaaagttgaggagagagaatacttgccaacttattctatgaagccagcattattttgataccaaaatcagatcaagacattatgagaaaagaaaactatatgtattagtgtctgtcataaacatagatgtaaaaattcttaacaaaattttggcaaatagtatccaacaatatatacaggatgatacaatatgactaagtgaagtttaccccaataatgcaaggtctcttaaacatgggagaatcaattaatgtgattcatcagattaactaataaagaaaaaccatataatcctctccgcagatgcaagaaatcatttgacaaaatccagcatctacttatgataaaaactctcagcaaaatagaaagaaatttcttaatcctgataaaaaggcatttatacacaacctacagttagtaccatactagattgtgaaagactgaatgcttttctgttaagtttagaaacaaagcaaggatgtccattctcaacacttctacccaacattgtactggaggttctagctggtgcagtaagttacaaaaaagaaataaaatgcattcatattggaaaggaagcagtagaactgcttcttgcttctattcccacatgacatgattttctatgtataaaatcctgtgagacctacataaaaactacaagaaataataagtgagtttagcagagttgcaggatataagatcaatatacaaacatcaattgtatttccctacactaacaataaacaattggaatttgaaataaaaaccaacataatttacaacagcaccaaaactatgaaattctaaggaataaaactgtcaaaagatgtgtcaagaccaattaaatattgctgggaaaaatcatacaggacctaaataaatggaaagatatactatgttaatgaattggcacagtcaacattgttaacatatctgttcttcccaaatatatctatacattcaatttaatcctaatcaaaatcccagcaggtgctttgtttggtagaaattgtcaagatttttctaaatttcatatgaagtgcaaatgacccagaataaccaaaacaacttcgaaaaaaagaacaaagttgacaaaggtatactacctgactttaacacttattataaagacatggttatccacatattaggatattggggtcaagatagacaaacagatcaatgaaacaaaatagtggtttcaggaatagtgtgacacacagagggtcaactgagttttgacaaaggtgaaaaatcagttctgtaaagaaaggagagacttttaatgaattattctgggaaaatagaatacctatatgccaaaaaaaatttaatccatatctttcatcatatataaaaattatctcaaactgtatcataggcctacccatacaatctaaaactacaaaatttctagaagaaaacttagaaaaaaacttagggaaagtcttaaccttacagtaggcaccagaagtacaattataaaagaaaaaaatgataaacaactaaaattttcagactcttccctttgaaagacaatattaagagaatgaaaaacaaaatgctgattagaagaaaacatttgtgaatcatgtgataacaaatgtatatccagaatatataaagaactctcaaaactcagtattaagaaaataaatcaatttttaaaaatgagcaaaagatttgaacagaatcagagaaggtatatggaagggaaacaagcatttgaaaagaggctcaacatcactagccattaggaaaatgcaaatgaaaatgacaattagataccacttgttagaatgtctaaaatcattgccaaatgatgcgaattaagagaaactctcattccctgctggtgagaatagaaaatgttacaaccactttggaaaagtttgatggtttcttaaaaagccaaatatacatccactagatgacccagccattttactgctgaatatttacccaaaagaaataaaaacatatgccatacagagacttgtataggcatgtttacagcagctttatttgtaatagccaacaactagaaacatcctaaaagtccatcaacagatgaatggataaacaaattgtggcatatctatacaactgaatattactcagcaataaaaaggaatggatagttcatacacacaagacatggatgcatgtcaaaatcattttgcacagtgaaagaaaccagaccaaaagaatacattctgtatgattccatttatataaagttctagagagtataaacttaaatatagtgacagaaaacagatcaatggctccttggggatatgacaagattggtaggattacaaaggggcaaaaggaaacttttggggctgatgaatatattccttttcttgattgtggtgatggtttcacaggtgtgtatacatttctcaagtatcaaaaagggtacactttaaatatatgccgtttgttgtaggttaatgatacctcaataagcctactttaaaaagttaagctgggtgcagtggctcacgcctataatcccagcactttgggaggctgaggcgggtggatcgcctgaggtcaagagtatgagatcagcctggccaacacagtgaaaccccgtctctattaaaaatacaaaaaaattagctgggtgtggtggcgggagcctataatcccagctactcaggaggttgaggcaggagaatcacttgaacctgggaggcagaggttgcagtgagccaagatagtgccattgcactccagcctgggcaacaagagcaaaactccatctcaaaaaaaaaaaaaaggaagttaaaaaaataaagtagaaaaagaaaatacagaatgatgaggagggaagcaacttattttagacagaataatcagagaatgactctctgaaaaggtaatatttaaacagagactcaaaggtattgagggaacaagccattccagcatctaggtaaaagctctaggcagcgggaacagtaaatttgaggaccaatgacctgctctatattgtaatgccatggtgatcctgagggggtgaaactcagtggtacctcaattttggcatgttcttaatatcagtcttcttgtgtattgcatagccattgaagtcctaggagattgagataaatgtgttatttcaggacactgtctgaaaactgtcataactgcattaaaataaacccataatattagtttaggtatctaaaattaatttattcttttaaaagtaaaaggcagctaatattctgattaatttcagacatctcttaattaggttcgagttcattagggggaaaatacttctttttatactttattcatttcttcagcattcactgatttcttcaataaatatttatgttctaagcattttgccaggcggtggggagatagctttgaatatccatgtacttgtggaatttatagccttgtggagaaaatgagtttatcatttagagaaatgtcctttgagatgagagaaattaaaacttagagacatgacttcctattgtgaccacatagagatgagaaatacattagcaaaaacactacctgatttaataggtgttacttggtaaaactctgatgaaacagttaaggtgagtaaaatgatttggcagaggcagcagttaattatgtttgctaagcaggaaaatgacatttggaaaggatgaaggaaaacttctgaacaagagttttaaaaaaaagatgaagaaactggctgaaccctccaaaatgtaataactatctgtttatgctagcatcaaggtgactgacataaggcacatacttttcaaagaatgtgagtctttctagtgatcaaagccatagaaaatagaaggtagctaatatttattgggcacctactatgggtctggccttttatatatgttatctcattatgtaaaacaacatcaaacacatattgagcatttatttactgggagtcagcttctattctaaacgttctacatgtattggctcactttattttacagtaaactagtagtactattgttatcatctccttttatagggaatgaaaataagatacagagaagttatgaattgtctaaagctgcccagttaaaacttgaaccctaagtagcctggctccagagcctaactaagctttcagccactactctatgccgcttctgtgttccaggtgcacaggatgggaaacttgtccttttgcaggagtgagaatgctcatccatacacgtgccagcaagtttgttttaaaagggcttcttggggttactttgttgttgtttattctccttccccccttcaccttacattcattattcttggcttctaatgtgaaaagccatgagaaaaggcaggaggaaataacaagaggtgggagaatagtaaagcccatcacctggatatttttatttcatgtcagcaaagggctctgctgtgattttgaaatattgcagcttcagtgctgtttccacatgggtgctcagctggtctgcaatgcatggatgcctgtgctatgtgtccagaagacagctgccttgatgagatgggggacagtgtggaggtcggtagcccagactctcgagccagactgcctgggtttgaatcctggctcttttccatgatttaaatatttgctgcttctatttttaatatacagcaatagacttgtttctgggggcttagttgttctttggaagagtgaggggggacacctcaccccatctatctcatggttttatttgaagctgaaatgaaatagcacgtgaaaaaagcactgtaacttagagctatctcaatcgtagggatatattgttatctttactgccagtaaaatatatacctgtgttgttcattcagtccctcgaccaagagactggtcctgcgccatcagtgcatttccttgcccagttctctttgtttccaacagacaaaaatgcatggggtgagcagtctggccaaataacaggaaagctaattgtaccgtgaagtgatcagaattcccacacccatgatgttgttgaaggctttgtcttatctaatatgcaccaatagccaggtcttcagcactaagcagcctggtctttgcaatttatctaaaagtaaaaagagaaaaagcaatgtggggccaagagtggcaaagacaggatgattcttatttctaccgtaattagcaaaagggacaattagttattttaacatattttaaataaaggttggttatttttgaaggtactggtttaaaaaaagcacataatttcttaagaaggctatgcccacattggggaaagaaactgtgtattccactaataactaaagtgctggtgtctatgtgagcctgcctttctgtcttttacatcttgtgatacaggtataggagctaggagtgaatagtattcatttctgtaggacagaataagaaagatctcgactaacaaatctatttttaactagtaagtagcagtatctcatttttccaatcctaggtgtcctctgatctgagaattataaactacatgtccttcttccttatggagaaaaactgacagtaagaattagcaggaaaagagacaacccataagaacaatgcttcctcctgataaaaggatagccattctgaaattcaaaaatagaaatgcaaagcagaggtagcagacaacagaaaaatgaaagggattgtcattccaagaattggggaatgctataggtcaacaaagttctggatcataacgccgagatttaaataggaaaatactccaagattatggtctgatgttaaaatgctaagggaagtcaggagcttggattcaattttccctaaggccttgcattttatttctaactaaaatttcatggagcacttaagaaataccagcctttacaaaacagatctgacaacttatgtgctggggtatggtctaaaataggaaatgaaatttaagcctaaaatgctaaaatcttttggcagacaacaaaattatatatataggccatacctgattggaaaaaaatagtaattccgttgattttgttcttgttttcccttcttttaaggttgctggcaagtgtttgaatccccattgagaagaaggtgatcagagaattaagtcattgagccagtctgtgtgacagcctttgtgttaggaccagggaggaaagggaacatgtcccagcctcaaagattttagagtttagtgaggaggaaattaccataaagaatgatcagtattatattaaagatgtgtgcaagatatataaaatgttgaaggaaggggaggatgcttaacttggcttggatagagagcttatagaggagaccatctaatctgtgccttgaagacgtagtaggaatttttgaggcaaaaagaaggaagatggtgttccaggcagagggaacagcatgtgcaaaggtatgtttgaggaactacaaatgattcattattgctgtacttcaaaggttatatgtgcatgtatgaggagggaaatctgcacagaaatggaggcaggataagtaggaaacagacaatcaagggacttgtgtgccatgaaaaagagaactcttttctttcctgagaacagagagatttgatcaaattgttgttgcacaaacatcccctggaggatgtgggagatagacgaatacaggaaagaaactggaagtggaaaggtatagaaaacctgcaaggctctttctcttaaagagcaaatagacaaaatgacctaactaattattttaggagacagtctttaatgcagaggggcctccaaatattcttagtttcctagaacaaagtaagccctggttcaacagctgactggacttcctgtgaaagaaatttagtctgccatgcctcagctgcagaagtcagacatgagaggattcttcccatagagaagacttggtctaatgttggttcaaacttagcttgatagccatggcaaatgaacactctttagttgctagaagagcaatgttaaaatttcaggtgtttcgtgtatgctttacaaagtgatgaaaaataataacaatttttttaaaaaagatgatagctgagaggattaaagatgttgataaatacagaaagtgcttagaacagtacttgcatatatgcactgaataaatattagtgaaaataaatattagctataacaataaatattgactatatattattagctataataagtatttacctataataaccataatacatgtaataatgtattaataataattggctcctgaatcagaaacaaatttcaaatagtcacctctctgaataagttaggtactatctaaaatccatgaaatctgtgattttgaaagaactcatcaggaaactctggttcagtttttacatccatcactcttcagcagatgtattaagattaagtatgaacacagaagaggcactgaatttatttttttcatcttagcctattttaactgttccgaaatctcatgattagagtaaataccttctgtgatggatgcttatttaccttcttgataaagtcaactggtaaatctctaattcttataaatcagaagccagaaaaatgtctcaacctgaaaattaatgcttatttccattttctactaatattgtgaaaatccagggctaaaaactggtttctgcttcatttttccagcaatcgtaaaatgtttctttgggtaaagtgggataaattttcagagaatttgaccctcaattctgtgtgtatttttcacacttaagacaatcttagaaacttcacatgcaggaaatttaatttatttcatatagaagcattggctgaaaattataacataaaccaaaaacaaagaatagagctggcttaaaaatgttgaattaacagactaaaatatatttatactataatataaacatataattaggtaatttaaactaagcattgagattcataatgacccaaagtctgggggtagaaaaagagctttcttttcttctgttttctatacaactcagagccaacctgggaatctgtcatggacagttatattcaccaccaagcatgtgtccttctcttctgataaccacaattttccttgggggatttaccctctcattactcgtagttcctgtgcttgggaggagtttcttgcctatcatctactgggataggtatatgaccaaaatctggtgctgtcggtggcttctgagatggctgcattgattcttagttccttctactgaaggctttgtgcaagtccctcccacttgaataactttcttctaattaatagcatacctcaaaattgggaagatgtcacttccattattagattacaaagttctgactttgatcttactaagagatcctcttccttgctggtttactaggagatcctcttccttgatgaagcaagattctatgttgaggcccgtgccaaggaattgaagaaaatctatggccaacagccatctaagaaaggaggccctcagtccaacagatcaaaaggaactgaatcctatcaacagccatgtaaatgaactttgaagtgtatctcaggatgagccttcagatgagccccttgccctggcctacacattgactgaagctttgtgaaagggcctgaagcaaggacccagttaagccatgtctagattcctgacccacagaaattgcgagattataaaatgtatgctgttttaagctgctaaattttgtggtgatttgttatacaacaatagacaagaaatgcatctgggtgctttttatgctcccctggccaaaatgtttcattcagagttgaccacatgatccaactcagtacaataaaagttagggtctctctccctctgctgtacacacagggcataagattgcaaagacttaatcttggtggtattggaagtcttacttgaaccatttggagtctgaaaaggaagccaacatagagcataatagagtagaaaaatggaaagaggctggttcctaataaccttttttgagaatccagaatcaagctgcaactgaaacttgaatttcccttggatttttggatatgcccctttatattttacaaatataaaaaaattatattttcaaggtatatgtttttgcttaaaacaatttgagttatgaactaatatactacatcatgaaatagtcattgaattcctcttcttgcttttgtcttgcaaataatattttattctctctataaaacagtgattaattgttaatagagttaagaaaactgatgctcaatgaaggaattctctacttcagtacctgtggagtctaagataaatttttaaaaataaagtgctaaaaatcagctcagtagcatttacatagctagctgatgttggatataagaacattgacatggatttgaattgtatagtcacatgcattttgttttttaaaataatatagagacaaaatttccaacatgttgctttctactgtgtccacagaacccttcattctatgctgaattctactcaaagccaaataacatctttaagtttccatggacattgagcaaagtttcccagattctaccgtggttgtgttacaagttaagtattccttatccaaatgcttgagaccagaagtgtttcaaattttggaatatttgcatatacataataagacatcttgggaaagagacccaagtctaaacatggaattcatttgtgtttcatatacatcttgtacacatagtctgaaggtaatttaacacaatattttaaataattttgtgcatttaaataagtttgtatatcttgagccatcagaaagcaaaggtgtcactatctcagctgcccatgtggacaatctgtggttgtttggcatcatcataattcctgattctgaaattatatgctactgataagcaatctttttttatacttactcaacacaagtacttcatagtaaaaaataggacataccattaatacaggaaaaaataatgtgttcaggttagctaatccgcatagtaccatcaccagaatacctgcatcagctgttgaagaagagcaacaacaaatagttgcaggcttccaggctccacctacgatgctgtgttttgattgaaaggtttctgtacactgtgttttattttttatttatttacttatttttaattttacttttgagaccgagtcctgctctgttgctcaggctggagtgcagtagcatgatctccattgactgaaacttctgcctctggggttcaagtgattctcctgcctcaccctcccaagtagctgggattacaggtgcccatcaccatgcccggctaatttttttgtattttcagtagagatggggtttcaccatgttggccaggctggtttcaaactcctgacctcaggtgatccgcctgcctcagcctccctaagtgctaggattacaggtgtgagccaccacacttggcctgtgttttatttttttaggtgggaagaaacatcagacacaggtgagagaccaggaagtgggtcctccagggatcaggaggcattctactggttggctttttaaaatgtttcctccagagtcatttgcctcatttacaatgttttttgtcttttaagtttctctttgatttcataaactgacatgatttcttgttatgaatgcatgctgctctagaccttcaacaagtccatcacacattttcaccatgtcattataggcactttttcctcagtatgaatgtcatcttcatcattactacgatcatgatcaccttgattcagaaccatttcagctgcttcaggattggtcaatgaatgcacaaatggagcctcaatgttaaaaaaacttcattgatatgcacttctaccagcttactgattgatatagtttgaatgtcaaactatatcatgttgaggtgtaatccctagtgttggaggtgtttggatcatgggggcagatccctcatgaatggcttgggccatccccttagcgataagtgagctctcattctcagttcacatgagatctggtcattaaaaagtgtctggcacctcctcctaattatctctctctcgatcccattttctccgtgtgagatgcctgctccccctttgccttccaccatcaataaaggctccctgagagccccccagaagccaagcagatgccagcaccctgcttcctgtacagcctgcagagccatgcgccaattaagcctcttttctttataaattacatagtctcagatgtttctttattgcaatgcatgaacagcctaatatactgatagactctgaatgcatattttctgcatatgagaggaggtccaaaatcatttttttcacacttgacatatgggaatccttcaaagtaccaatttgttcatcatcatcactgaacacagccatagacaacaggttgtaccaggcatgcaaaactgtctttagtcactatgttccaagtcttggcaacagcatatacagtattcttcatgttaaactcctttacgaaaacgtccatgcccatacctctgttccctgacgctagcatgctgtttaataaagtgtttttatatttccttttcattgacttaagggtaccctaatcacatagctcaatgaatgaagtcacatttgaggaaaattgcatgacataaacttttttttatgagaatttcacctggaggatgagcagaacagttgttaaggaataacaaaatattgcagttgttattcagtacagcttccatgcagtgagcatgagccgctggtacaaaatgtttgtgaaatcaatcaggaaacatgtccctgatgatctatgtctttctgttagcataataacagaatggtaagaaattcactccttgaaaacagcagggacacaagcttttgcttaaaacagcaagtttacacttatgtatgtctgctgcattagcacatcccagcagaggtattacccttggcctccttaattcctgtctaggctgtctcatcagctgtggttagtgtcttcctggggcaataatggcaataatgccaaaacagtgatgtttcatcagcattatagacttgttctagcatcagattttcacaagtgatgaccttggcaaacttgttactaaatttttttttcactgctttgtaatcagcagatgctttactaccacaatctttacaagtctaatgctgtgtctcttcttgaatattcatggttaacttcaattttcagttcattgtgatagatctttgtttgtttcataatcagaataccattaagtggcacgtgttcactgcaacaccaacagatccattccttccatacacaattgagatattccattttggctttatgcagtgtttttctatttttcattatcttctgctcatcactttcagtatagaacttgaacagtttatcctgctatttcctcaggtcatatccagggtcattccaacgccatactcttctgtaagatgcttcacacattcaccaatatccaatttctccaacagcttggctttctgtggcatagacaaacattaattcttcctctttttaaaatcatgattatccatacccacaggggtgtctgtaggccatttggactctttcaacaatatctttttaccacgaagcagagattaagcaaaaaatccacaatgggtaatgcacatgtcttggccccacacaggacatcatggcacctcatggggaacctgctgttggcatatccaattaacacacatgctttcttattacctttgactggcaggcttgttgggggagaggaatctgggcaggcatgtgaatatgttgcaattgaagagggctgggggccctttttacccttggggatgctgaataaattaaaataatttcaggcactatcaactttgttgttgtatttataacaatgcagggaatgtttccccaaccttttaaatgtttgttccctattgttattatatttttctgctttgttcattatttattttatatcaaatatggtttcattgaaaataactttatatgcataatttgcctaatagatcataaataacttaagaccattcatgtaataagataacaaaaataacaatatttttgtagttttagacgtgctttaaataaaatagtaagaacaaaagttcataaaatcttatcgaggtcaaatgctagcccagttgttgatccaaaaccagatatctcttcaactcaccctaatgaactatcaatgactaatcataaaattgggataataaaaataatgctttagcatgataaaggaataccaaatatagagacaatgtagaaaaaaaggttagcagtaataaaataaaccttggctataacattcatttctataaactatagtaattatctagatcaaatacatattatggattgactaagtgtgatgatagaaaatgggcttaggaaggatataaatttagttgaggccgggcgcggtggctcatgcctataatcccagcactttgggaggctgaggtgggcggatcacgaggtcaggagattgaggccatcctggctaacacggtgaaaccccgtctctactaaaaatacaaaaaaattagccgggcgtggtggcgggtgcctgtagtcccagctacttgggaggctgaggcaggagaatggtgtgaacccaggagatggagcttgcagtgagccgaaatggcaccactgcactccggcctgggtgacacagcgagactctgtctcaaaaaaaaaaaaaaaaaaaaaaaaaatttagttatctattttaaggaataaactgaaaagacatgcattgtgtcatttaccttaacaaacagtttacaagagtgccatgcattctctttcctgccatccttcttgacttcaatagcattttgtaaaagatgatggtttagggccatgtaacagctggcttagtatattagctctaggaaattttcttaacaaagagcagactcctaattatgtgaccatgggaaaaactctctatgaatctcctttctcatctataaaattaggaaaatctgtaaagtgagtacctatataatagggttgttgacagattaaatgtgataatacttaacaacagtgctgacatatgataaatcctcaataatgctaactgtaattactattataatatcactgtgactattgttatttattattagtatcatcaaaattatttggcatttaaggttctccatcatttgggcttaatcaaccccaactgcatttataataaaccctaggctgtaacattcatttctatgaaccctttcctccttgttatgagaatgcttccttctatttattcattacctgcctcatggcttcttgcttccctgtttttgttcatgctatcctttctacctataataatctgtggctccctcatcctttttgccaatttcctcctggctttgtgctactgatcctttgaggtcctttcatctcctcagcaagaatttctaggatacttccagttttcttcttcttataaactcccatagtacattatttatgcctcttacaaggcattttaaacttttgatactgttaaaaatgtacatatacattgcatatttttcacaagactttaaacacctagatgatggaagccatgtcttaaccatctctgtgtcccacacagtacctagcagaatgccttgcacaaagggggctaaacagatattctaaataaatggtgattataggaatcagacatgtaatttttgcttcattagaagaatcttctaattaactggactaagcagtgcttactttcccaaaaagttgattatagagactcactgttggaggtttgtttcttaggtaatcaaggctgatcactggatttctttgattttcccaagattggggctaatgcctgaaattggggaaagttctttgagggaaagggtttttttttttttttttttttaatctgaacgaaatttcaaaaaagggaatgcttcttacttgaccaaaattgaaagcaccatgggataaaaatttctgagttatgagtctcaggggtccaaacacaaaaccccaaagcatggcctcttggtttgctgactactttgaactgaaggacactgaaagtgcctcagaagcaaggtctttctgatcctctcctgccttctttctccctctccactttctcccccaaagcaagccataaaacctaggaaggtctctgacctcctcccctccctactgactgtcctcatatgacagatgtcctgtcccatatctggggtgaatctgaacaaacaggcctaagtttctccccagtttacatccattagagtatactgttttctccaaccatacttctacatgactatccattcttcatcaaatctaagcataaaaatatagctttccttgggtttgtgggtgttcatttctgaagccttgtgtgtcacataaactttggttaaataaattcgttatgcttttctcttgtcaatccatgttctgttatagggatgttaaccatgatccttgcgataagttaggaaaaagaagccttggcttttttttttggctcccaataccttgctcacagaataaaactttataatttctcataatatgtttttcttttgaaagccccaaccatccactgagcttgaaatctatgttttatttctgaaggctcattattctagattttagctttcatttggacaatgatcaaagagaaacaactttcacagcctcaaggtaaaagattgtaaacagcaaattagtgaacaaaagtatttttctttagttttatcttaaatgtataagaacaaaaaccaagatggccttcacaagagaaaatattccttttccaaataatattggctaatttgaaattttcatattcaaacaaatttaattttgtgagtgggaaaaacattttttcaagagaaagttttaggtattttcttattttttatttttttgtgggtacataatgggtgtatatacttatggggtatatgagatttttcatacaggcatacaatgtgtaatgatcacgtcagaataaatggggtttccatcaacagaagcatttattctttgtgttacaaacagtccaagtacactcttttagttatttttaaatgtataattaaattattatatttaattatataactaatgatagttaccctgttgtactatcaaacaccagatcttattcattctttctatttatttgtacccattaatcatctccccttcctccttatcctcccactacccttcccagcttctggtaaccatatgtattagtccattttcacactgctataaagaactacatgagactgagtaatttataaacaaaagaggcttaattgactcacagttccacatggctggggaggcctcaggaaacttataatcatggcagaaggtcaaggggaagcaaggcacattttatatggtggcagggcgtagggactgccacacacttttaaaccatcagatcttgtgagaacttgctatcatgagaacagcatgggggaaaccacccccacgattcaatcacctcctaccagttccctcccccaacacatggggattacaatttgacatgagatttgggtggggacacagagccaaaccatatcatcatcttactctctatctccatgagttaaattgttttaatttgtagctcccacaaataagtgagaacatgcaaagcttttccttctgtgcctggcttattttacttaacataaggacctcctgttccatcgttgttgctgcaaatgacaggatctcattctttttatggctgaatagtactccattgtgtatatgtattacattttctttatcaattcatctgttggacacttggttttttccaaatcttggctattatgaatagtgctacaataaatgtgggggtgcagatatctcttcaatatattgatttcctttcttttgggtatatacctaggagtgggattactagatcatatggtagccctacttttagttttttcaggaacctccaaaccgttctgcataatggtggttctaatttacgttcctactaacagtgtacgagagttcctttttctccacgtcttcaccagcatttattattgcttgtcttttggataaaagccatttaactggggtgagatgatatctcattgtggttctgatttacatttctctgataatcaatgatgttgaacacacttttatatgtctctttgccatatatatgtcttcttttgagaaatgtctattcagatcttttgctcagttttaaatcaaattattagattctttttcctgtagagttgtttgaggtccttgtatgttatggttttaatcccctgtcagatggagggtttgcaaatattttctcccactctatgggttattaattatatgaaatatttagaaagaaaacaatagttgcatccatatctgaaaaatttagagacactgatgacatgatgaccttcattccctaatgtttttatggatgatctagatatcacaagacacattaaagaaactacactgtagggaatattcaacagttggattgagcttatgcagcgtttcccaaagttttagaaattccatcagataacaaaaggaataatgtccaataagaatcattggtcttaggtgcagtggctcatgcccgtaatcccagcactttgggaggccaaggcgggcggatcatgaggtcaggagtttgagaccagcctggccaacatggtgaaaccccatctctactaaaaatacaaaaaattagccaggcgtggtggtggtcgcctgtaatcccacctacttgggaggctgaggcaggagcatctcttgaaaccagaaggcggaggttgcagtgagctgagatcgtgtcactgcactccagcctgggtaacaagagcaaaactccatctccaaaaacaacaacaataacaacaacaaatcattggtcaaggaagtttgggaaatagagggcaaagcaggttaaacagatttctttaatgtagatccctgagactttgacatactaattttcctcatgaatctccaataagggttatacggcattgatgtttcctgacctcatatggccaaggattactcttgacttttttctgtcagagcaccttgaaggactgacaatctatgaagcacattttgggaaactcatgtctaatattatatacaaaggaggttaatgacaatatgcaatgaaaaattaatcaaaatgcagtttcatataaatcaaatatacatttcacttataatatcaaatataaaaaagacatagtcttgaagtaaaatgagccttatcatctcaaatgggtaatctggatattaattcacctgttgtttagaatcttattcattaaacaagcactcagtttttaccttctttgtgacaagcactgtgttcagtaccaagataataaaagatgatagtaacacaatatatcttcccatttagattgcaattccacagagttctaaaggtactttctttggcaaaatagttcaaaaaatatgtcaagagactatatcaataagttattgagccatagactattaaagaagtgggaggtcaatagaggagagataagaaggtttcatggtgtgcaagattggaatttggcctagaggactgataggaggtacagtttagctccatttgggttcaagcatagaacatgtacagaataaagaaaagacttagggctacaagttcatattagaaacatcccctagacctagagttagagatctagattccaattccagttctaaaagtcacttgctatgtgaccttagctatcttgtctatctatagattatggaaaataatgcctgttttgtctatttcaaaatatcattaggagaaaacacctatagatagcatagtatgttgttaatttttggagttcaaactatatttatctaagttcgtcaagagttagtgcaaagcattgcttacaatgtatcctcaatgaacatttatttcatgaaagaatgaatggataaaagaagttagacctgaatttcctctgccacttactaactaggtcatacatgaccttagttaaattacttagtcaccctgagcctcaggtttcgtatttctaaaatgagggttaaaaattatgcttatatcacaagattgctctggttaaatggaaattgatgaaaaattcttagcacagtagttagtatatacttttcatcacatatacatcctatatattggataattaaagacaattcatcaaatataaagtacagtgattgtgtttatgataaaaactatcacatagcagagaaggagaagtgagtgttcaacatgtagttgtgaactgacacttttggtccaagagctgcatcagaacacgatgagtgacacacaatgtgcaccataacatcaccaagaatgtgagtttaaaaagtatcagatcattgactgattcttcagaaggatcctagattaccatgccatttaaaaatatgtgtaagaaaagcagagctcaaaaattatgtatgagaggctttccagtgtacgttgagcctcaaaggaataaaataaactgaaatttagacatttactcacaacgattggtatagctcagaggtgataatctctggaaagagtattgataatgttaatcattttatagattttaaattggtttgtgttctactgggaaccaaagaagatgtcatgaaggtggctggcaagatggacgaataggaatagctctggtctgcagctcccagtaagatcaatgcagaaggtgggtgatttctgcatttctaactgaggtacccggtttgtctcattgggacggttagacagtgggtgcagcccatggagggcgagtagaagcagtgtgaggtgtcacctcacctggaagtgcaaggggtcgggggactccctcccctagccaagggaagccatgaggaactgtgcagtgaggaacggtgcattctggcccagatactacgcttttcccatggtcttcgcaacctgcagaccaggagattcctccagtgcctatgccacaagggccctgggtttcaagcataaaattgggcggccatttgggcagacaccgagttagctgcaggagttttctttcataccccagtggccctggaacaccagcgagacagaactgttcactcccctggaaagggggctgaagccagggagccaagtggtctagctcagtggatcccacccccacagagcccagcaagctaagatccactggcttgaaattctcactgccagcacagcagtctgaagtcaacctgggatgctccagcttggttggggaaggggcgtccgctatgactgaggcttgaataggcggttttcccctcacagcaaaacaaagctacaggaagttccaactgtgcacagcctactgcagattggtaaagctgctgtagccacactgtctctctagattcctcctctctggcagggcatctctgaaagaaaggcagcagccccagtcagggccttatagataaaacttcatcttcctgggacagagcacctggaggaaggggcagctgtgggcacagcttcagcagacataaatgttcctgcctgccagcgctgaagagagcagcagatctcccggcacattgattgagctctgctaagggacagactgcctccttaagtgggtccctgacacccatgcctcctgactgagagatacctcccagcaggagtcgacagacacctcacacaggagagctctgactggcatctggagggtgcccctctgagatgaagcttccagaggaaggatcaggcagcagtctttgctgttctgcagcctctgccgctgatacccaggcaaacagggtctggagtggacctccagcaaactccagtagacctgcagcagaggggcctgactgttagaaggaaaactaacaaacagaaaggaatagtatcaacatcaacagaaatgacatccacaccaaaaccctatcagaagtccaaaggtagataaatccatgaagatggggagataccactgcaaaaaggctgaaaattccaaaaatcagaatgcctcttcttctccaaaggatcataactcctcgccagcaagggaacaaaactggatggagaatgagtttgacgaattgacagaagtaggcttcagaaggtgggtaataacaaattcctccgagctaaaggagcatgttctaaatgaattgctaactagaataaccagtttagagaagaacataaacgacctgatggagctgaaaaacacagcacaagaactttgtgaagcatacacaagtatcaatagccaaattgatcaagcagaagaaaggatatcagagattgaagatcaacttaatgaaatcaagcatgaagacaagattagagaacaaataatgaaaaggaacaaacaaagccaccaagaaacatgggactatgtgaaaagaccaaacctacgtttggttggtgtacctggaagtgacggggagagtggaaccaagctggaaaatactcttcaggatattatccaggagaacttccccaacctagcaagacaggccaacattcaaattcaggaaatactgagaacaccatgaaggtactccttcatgagaagaacaaccccaagacacataattgtccgattcaccaaggttgaaatgaaggaaaaaatgttaagggcagccagagagaaaggttaggttacccacaaagggaatctgataagactaacaacgtatctgtctgcagaaaccttgcaagccaggagagagtaggggagccaatattcaacattcttaaagagaataattttcaacccagaatttcatatccagccaaactgagctttaaaagtgaaggagaaataaaatcctttacagataagcaaatgctgagagattttgtcaccaccagttctgccttataagagctcctgaaggaagcactaaacatggaaaggaacaaccggtccagccactgcaaaaacataccaaattgtaaagaccattgacactatgaagaaactacatcaactaatgggcaaaataaccagctagcatcataatgacaggatcaaattcacacataacaatattaaccttaaatgtaaatgggctaaatgacccaattaaaagatacagactgacaaattggaaaaagagtcaagacccattggtgtgctgtattcaggagacccatctcatgtgcaaagacacacataggctcaaaataaagggatgggggaatatttaccaagcaaatggaaagcaaaaaaaaaagcaggggttgcaatcctagtctctgataaaacagactttaaaccaacaaagatcaagagagacaaagacgggcattacataatggtaaaaggatcaatgcaacaaaaagagctaactattctaaatatatatgcactcaatagaggagcacccagattcataaagcaagttcttagagacctacaaagagacttagactcccacacaataatagtgggagactttaacaccccactgtcaatattagacagatcaatgagacggaaaattaacaaggatattcgggacttgcactcagctgtagaacaagcagacctaatagacatctacaaaactgtccatcccaaatcaacagaatataaattcttctcagcaccacatcacacttattctaaaattgaccatataattggaagtaaaacactcctcagcaaatgcaaaagaacggaaatcataacaaacagtctctcagaccacagtgcaatcaaattggaactcaggattaagaaactcactcaaaaccacacaactacatggaaactgaacaacctgctcctgaatgactactgggtaaataatgaaatgaaggcagaaataaataagttatttgaaaccattgagaacaaagacacaatgtaccagaatctctgggacatagctaaagcactgtttagagggacatttatagcactaaatgcccacagcagaaaacgggaaagatctaaaatcaataccctaacatcacaattaaaagaactagagaagcaagagcaaacaaattaaaaaggtagcagaggacaagaaataactaaaatcagagcagaactgaaggagacagagacacgaaatacccttcgaaaaatcaatgaatccaggagctggttttctgaaaagatcaacaaaatagaccactagccagactaataaagaagaaaagagagaataatcaaatagacgcaataaaaaatgataaaggagatatcaccactgatcccaaggaaatacaaactaccatcagagcatactataaacacctctacataaataaactagaaaatctagaagaaatggataaattgctggacacatacttcctcccaagcctaaaccaggaagaagtcgaatccctgaatagaccaacaacaagttctgaaattgaggcaggaatgaatagcctaccaaccaaaaaaaagtccaggaccaaacggattcgcagccgaattctaccagtggtgcaaagaggagctggtaccattccttctgaaactattccaaacaatagaaaaagagggactccaccctaactcattttatgagaccagcatcatcctgataccaaaacctggcagagaaacaacaaaaaaagaaaatttcaggccaatatccctgatgaacatcaatgcaaaaatcctcaataaaacactggcaaaccgaatccagcaacacatcaaaaagcttatctaccacgatcaagttggcttcatccctgggatgcaaggttggttcaatatatatacaaatcaataaacattatccatgacataaacagaaccaatgacaaaaaccacaattgtcttaatagatgcagaaaaggccttcaacaaaattcaacagcccttcatctaaaaactcaataagctaggtattgacggaacttatctcaaaataataagagctatttatgacaaacccacagcccatatcatactgaatgggcaaaaactggaagcattcccttagaaaatgggcacaagagaaggatgccctctctcaccactcctattcaacatagtattggaagttctggccagggcaatcaggcaagacaaagaaataaagggtattcaaataggaagagaggaagtcaaatgcctctgtttgcagatgatatgactgtatatttagaaaaccccatcgtctcagttcaaaatcttcttaagctgataagcaacttcagcaaagtctcaggatacaaaatcaatgtgcgaaaatcacaagcattcctatacatcaataatagacaaacagagaggcaaatcataagtgaactcccattcacaattgctacaaagagaataaaatacctaggaatacaacttacaagggatgtgaaggacctcttcaaggagaactacaaaccactgctcaaggaaataagagagaacacaaacaaatggaaaaacattccatgctcatggataggaagaatcaatatagtgaaaacgtccatactacccaaagcaatttatagatacaatgctatccccatcaaggtatcattgactttcttcacagaattagaaaaaacagtgctttaaatttcatatggaaccaaaaaagagcccatatatccaagataatcctaagcaaaaagatcaaaactggggacatcatgctacctgacttcaaactatactacaaggctatagtaaccaaaacagcatgatattgttacaaaaacagatatacagagcaatggaacagaacagagtcctcagaaatcataccacacatctacaaccatctgatctctgacaagcctgacaaaaacaagcaatggggaaaggattccctatttaataaatactgctgggaaaactggctagccatatgcagaaaactgaaactgcacccccttccttacaccttatacaaaaattaactgaagatggattaaaaacttaaatgtaagacctaaaaccataaaaaccctagaagaaaacctaggcaataccattcaggacacaggcatgggcaaagacttcatgactaaaacaccaaaagcaacagcaacaaaagccaaaattgacaaatgggatctaattaaactaaagagcttctgcacagcaaaataaactatcatgagagtgaacaggcaacctacagaatgggagaaaatttttgcaatctctccatctgacaaacagctaatatccagaaactacaaagaacataaacaaattttcaagaaaaaaaaaaacaaataatctcatcaaaaagtaggtgaaggatatgaacagacacttccctaaataagacatgtatgcagccaacaaacatgaaaaaaagctataatcactggtcactagagaaatgcaaatcaaaaccacagtgagatattatctcatgccagttagaatggtgatcattaaaaagtcagggaacaacagatgctggagaggatacggagaaataggaatgcttttatactgttggtgggagtgaaatgagttcaaccattgtggaagacagtatggtgattcctcaaggatctagaaccagaaataccatttgacccaacaatcccattactgggtacatacccaaaggagtataaatcattctactataaagacacatgcacacgtgtgtttactgcgacactgttcacaatagcaaagacttggaaccaacccaaatgcccatcaatgatagactggataaagaaaatgtggcacatatacaccatgtaatactatgcagccataaaaaggatgagttcatgtcctttgcagggacatggatgaagcaggaaaccatcattctcagcaaactaacacaagaacagaaaaccaaacaccatatactctcactcataagtgggaactgaacaatgagaacacatggacacagggaggggaacatcacacactgggcctgtcagggagtagggaactaggggagggatagcattaggagaaatacctaatgtagatgacgggttgatgggtgcagcaaaccaccgtggcacgtgtatacctatgtaacaaacctgcatgttctccacatgtatttcggaacttaaagtataataaaagaattggctgggtgcggtggctcatgcctgtaatcccagcactttgggaggccaaggcgggcagatcacgaggtcaggagtttgagaccagccttaccaacatggtgaaaccccatctctactaaaaatacaaaaattagctgggcgtggtggcaggcaactgtaaccccagctactcaggaggctaaggcaggagaatcgcttgaatccgagaggtggaggctgcagtgagccgagattgtgccactgcactccagcctgagtgacagagcaagactccatctcaaaaaaaaaaaaaaaaaaaaaaaaagtcacatattgtgatcataacagaggtaggtgtttgagctggtactcttattctgagaagcatccattggctttgatacaaattttattgttaaaaatgatttgaaaattgaaaattgtcttgcttgatttccctactatctttgaagtattttcagttcaatactttgaaatatttcagggttcaataaatcaatgagacatatggattatctagggagaatctatttgtttctctaggccattgaactgttggaagcacattaattattcatgatttcttctgattaacaaatttgtactatctgaaatacatgttcagtactattcaatactttattaaaagttatattatttactcctaaaaaccagagttgggtacataattatttcttttgttagcattttagagatataaaaggggcttatttctaataacaacgaagattaaccattacacaaggcattctagaaatgagtggtcataatatcacattttaaataattgaaaaacgtatacaaatatatgttgcccaaaataaagcatgacgtcaaccatctgttataatataacactgcattttcttacattctctaggtaaacattatagggactattatgtaaaaaaattccaaattattctaatagctctattcttaaaaccattaagaagattatctctgtttttaatattcaatataataaatacaatttgagtgcaaaagtttaaaaagttttatactatattttatataataataacttatgctactttactctcctagtattgcaagctaaaatcttttaataccaaagttactgaagaagagaaaaatttttaaattaacactttaatatattctgtcttccatctcttagacaacctgttgtcaaattctggcatctcttcctacttcttcagatttgacttttctttggattcatattgcataccttacacctgcaataaattatatatacctttaatatgcttattccttgtacataacagctatagctactgttgggctcagaacatgataccctgaaatatggcactttggcaattgagaagactgcagaagcaggaaggttgcttttactttctcctccctttttcttctaaagaacattcataaagagttatcgacctatctcacctgaatgtaggtcataagaacctcacaccacacaggtcctaccctatacccagaaactaagaaaaatctgaacaaagaggtcctggtaagttccttccagtttattacaaatagttcatatccactttttgtccaattatacatctacacaactgttcattcttcattaaacttaagtataaaaatacaattttttctggttctttgggtcttcatttctgaaggctcttgtgtcatgcaaaactttggttaaatacattatgcatttttcttgttatcttgtcttatgttgtaggagtgtcagttgtgaaccttgtgatgggtgaggaaaagatacttctttttctttcctagaatactcaatacatgttatatgaatgaattgctcatctgactttcttcctggcctctctactcagccactgaatctctggggacctagtgtaagaagacagattttccatgtatttctagttcttttttttttttttttttttttttttgagatggagtcttgctctgtcacccaggctggagtgcagtggtgcgatcttggttcactacaacctccacctcccaggttcaagcgattctcctgcctcagcctcctgagtagccgggactataggcgcatgcccccacacctagctaatttttgtatttttagtagagatggggtttcatcatgttggccaggatggtctcaatctctttacctcgtgatccgcccgcctcagcctctcaaagtgctgggattacaggcatgagccactgcacccagccatatttcaggctttaaatgaaatggaatatatattttttaaaggtaagtttaaccagaatacatttattcatgggaatttttttatttacacccatttgaagactaagctacatttgaaattgatatcatattgcataaacatatgaatacatgtatttgtctaacataaagtcttcaataaatatttagtgaatgaataaaagtatgttatactcaacataaatgagtttaggtcatttcctgatgactttgaggggtcacagatgtgctggtgctttccttgacacaactttctcttacccctttagtttaaatatatatatttaattattttaaaaatagagtttcatattttgagttttatttaataaaacagatcatcaaactcataaatgaagcttgtaaaacattttggaatgacttcatccacaaattttgaggaatgaaacaaaaaagaaatggatattaaaactcttaagaggccaatcaaccatttgtgttttgatattattagcaccccaattcaaacacacaaaaggttaaaaaataaattataaaacaactggggacatttggacatcaagtgggtcttggataatattaagcaattattgtttgatattccattaggtactgtaatggtattttggttattttttaaagttgttatttttacatgcaatatattaacagatgagatgatatttcttagactttcttcaaaataatcctgtgtgtatatggggagtgaatgcttggtatagaaggaaatatggttatttgttgataggttttgaagttgggtgataggaacatggatgttcataacaccattttctttacttctgtatatatttgaatttttcaaaaataaaaaggtttttttaatcatgctaataaaactatcagaggaactttgaaaacattggattcttgagataaagtggctttccagaaaaaaagtggcatgaaataaaatgctctcatactttgtttaactgatgtactttatttaaatatctttactatatattattggtttcctagttagctatgccaatatattagatggtggaatcatgacctatagctagctgagaattttaaattttactgactttattgactccatactcttcatggacactaatttagtcagacaagttacagaactccaataacgtaataaacatgttaagtgcctagtgtattaaatctcttctgaaaatctacctttttgatgattttgagcatggatttctaataactgaatgccatagtgtcaaatgttgatttggtcaaagatactgtttttgactggatcaagcaaaaacacttcccaaaatgcagcagcagcacaatctgttatattgcaatgagaaaaaaaaattggcaaggactataaaagttacttaagaaagaacttcacaaggagatgaagcacaaatggaaatgcctcagaaagtagaatgtagggcaaatttctaaggagatcacaaagaaatagcaaaagcttgtaggagttgggtcaaaaaagctcagcaggaaacaggatgccacatctaagaaacatgaaaggaaacagaaaaaagaattcttttactatttcaggaacaaaagaaagctaaatgacacactttgctccttcagtgaagagaaaaggaaatctaatggtccatgatagtaaaaatgcacatgcaattggtaatttaaaaaaatcctccttaaaagaaagataaagtagaattatcgagcatttattgagaggtgcaaaatttaaggcgcaagaaaatatttaaaaaattaatctaacataacttaaccattatgatgtgatttatatgcaaagatacctaaaggattcaccatccacatataatggaatattatgcagccaataaaagttattattaataatattaaaaaagttaataatatgatattaagtaataaatgccaaatcatgttgttgtctggaagagaatcgtcaaattgtcaacagtagtttttgctgataatattactggtgatttttatttttgtcatctatttattcatttgttggatattctgcaatgggaattacttttataatcaggcataacaataaaaatattattcaaagtacctactgtagtctccaacagttcaattccaagtagtccatttaaaggactcttgttaagttgccaataatcactgctttgataaatcaaatggatacttgctcttatttcctggctctgtgaagcatctgacttttttcaatgttccatgctaaaattctctgctcccttggcttggtagttctaatttaaccatgcatcagctgtcacctggaagactgcaatggctggctgtctttactacaagccattctgtcaattaccaccagggcaatcctgaccacattactccattgcttttgcctcttcaaagacttatcttacagaacatagagggtgagttgctctggatgctttctgtttttttttgtttgtttttgttttttttcttttttttaaattttattattattatactttaagttttagggtacatgtgcacaatgtgcaggatagttacatatgtatacatgtgccatgctggtgtgctgcacccattaactcgtcatttagcattaggtatatctcctaaagctatccctctcccctcccccaagctttctgtttattagtgacccaatgaaaagaaaaggacaactttgggtccagggattgtaaattgtgtcctcaaatctctatttcttgcttctgttctctcttaggtagttgtatctcataagcaaaagagcttcctctcagtgacagggatgagagggcagggccacagataattccaggcttatatcatcctacctagcaaccccaaagccaagggagatatcctctctcccattctctgtgtatgaaatccaaaggaaagtctctggttgactaacagtaccacacctaattgctaaggccaagaatgtgggcctgggtcataggtccaatctgaacggagagatattgtactatgattggtagcctgatcagaactacagcacttggaaggtccaagggtaagtgcttcaaagaaaatcagggataattaataacagaaaagagtaaggaatattggaaagatgaaaaaccaaatatcctttataaaaagtaatattcaatctccttagcccaacactcttagaatttcttggattggcctctgctcatgtttcttgcctcatctttcgccattccctcccaagaactccagtttctaactatgccaaacacttggatcttttctgaataggcagtgctaggcagaatagtggcccccaaagatgttcatgccttaatcctaggaacgtataaacatgttaacttgcaagacaaaagatacactgcagatgtgattaagattaaggactttgaaatggaaagatcatcctggtttacctaggtgggcccaatctaatcacatgagtcctcaaaagcagagaatctcttccagattcagataaccagaaatatggcaatgtgaaaagaactccatccaccattgctggctttaaaaatggaggaagaggctacaaatcaagaaatgtgggtggcctttagaagctggaaaatgcaaggaaatggattttttttgaaagcctacagaaagtaatgcaatcctgttggtattttgattttagctcaatcagacttttgtctcactttggatctattacagaactgaaagataataaatttttatcgtttaagcttccaagtctatggtaatttgtcacagcaataagaagaattatacaggccattctatgtcatgctttcttgattttgtactttctggtcatttcatgtaaaatatctatcttccacatctatcttccacactgatgcaccccgctcaatcccagcccacttggtgaactccctacccttattcaaactataactcaggtttcactccttctctaaagccttccttagcatcactcctaggaatatgtgactcctaggaatacttttttcttatggccacacagcactctgcattcttccgctatagtatttaaagtgctgtatgaaatttgtctcagactgtaaatttatattaggccagggactatatcctattcctcaatgtatatcacaggtaaagcatgttgagcacatagtacattttaataactgcttgtgtatgcatgaaaaatcattgcactggttactcactttgagatttatataggaatgagaaagagttgaaaactgaaaaaggtccagcatattttaaaaagagaacatgaatatagcactagggatttaacttctactgccacaaaaatgttggaaatcaacgagtagtaggtcaattgtcaaataacttgaggatagcaggtacatttttattatgagcaaatcttgtctaaattagttgtctaaactcttccttctacatcagtaactgaactgataaatttgggagtaagaaattggttgtaatcaatctttcttgatgtgacaaggctttagattgaattctaaagatcaatgaacttggaaaatgtggtctcttctctaatggcattaattaataacatctaatattatcacctagaatctggccaatacatttacatagaatcagcctgcaagagggtcctcaaatgattcttggcttctcatattcactcccttatgtagtccctcccaatactgaataggtctaacctgtgtgaccaatgggattttgaaaaagtaacaatgtatgatttctgaagatagatcttaaatgaattgctggttccaccttacttttttgaattgctcctacttctaggggatgatagataccatgttgtgaggacactcgagcggtcctgtggaggggcccattagagaaaaactaaggtcttccagcaaaagctagtactaaattgccagctgtttaagtgagccactttcaaagcagattccccagccccagacaaactttcagatgactgcatccctggccaattttttgactacaacctcataagagaccttgaacaataattacttagctgatccactctcaaattcctgacctgcagaaactgtgagaaataaataaaagtctattactgtcttaagtcatgcagttttagataactagttttagataacatgcagcaatagataactagtattctgcctatagaataaaatagacaaaagtcactataaactatttcctgtgttgttagccgtggttttttaaaaacaattattatcctttcactttcagccctagtcttccaaaccaataaacaagagtcttagaaggaagataacttcaaggcacatctgctccttttagattttatactaaaaacaaaataaagagccagtcttattactctactgccaattctcggtaataagtgacatttcctcctcccttgtgtctgtatttttttctactattgaggcacctgaaattggatgatgagatttccaatgtgcccttagaaaatgagaaagacatgacacactgtaactctcctccttataaggctcaggaaagaaatatacctttttgggcctctctattttcctgacagaaaaagagagagagatagaaggtagaaaagctatctgccatccttcagctatgatattcctgaggctcatcatatttttcttattttagagagtctgtagagggacacgtactcagtgtgttatatttgctcctttatgtgtgaccatcacagagcaaatgtcttgatgtcatctcatcaaaagcatcagagatgcttggagcagggagaagaaagggggtaggaagaagagagtgatgaaaaagggcaaaggaagaacaggagagggccaattgtgtagaaacagcaaacagcctgacttgttcaggcacaggccagaactgctcctaggctgttgagttaacacagatacactctggttaatgctcttaagaagatgaattaagtgaaacatttcagttctaacaaaagtggttcctgcaaaaaggagagatggggcacaactagaagaaaaatacttgcattctagtttagttcagtctcttcagagaaggtaacatattacagtggaactacatcataaggtaaatttcaaatcagataaaatatttatgattttgagaaaacatttcacatgaatctataaatacctagcctaaggtttactgctaccatcgtttacaggttaattagcgcattttgcagccttgccataaatctgcttccatttagatagaatggctagatggttgtctttagcatcctgaaatttaatagtagaactatgtagcagattctagtctttctaagcaggaatgacaaaatagtttcaaattattatttttttgtcatcatatgactggtaacatgtcattggcacttaaattttatgagtgtctatttattaggctacagaaataattttgttctccattgctctatgtataggtggggaagctagtgacctcttcaggggtggtttcagaagttaagggggtgtagccaaaacctggtgttatctccttagcttgtctaaattcaggaaagtcactggagaataaaaaagaaccaattttactataagacaatgaagattctaggcagttcttagaaataggtaagaaatctaagctccacaagggcagaagtctttgctctttttctttcctatgcactcaacaagaatttcttgactgtatgaaggagccagggaatgctcagaagaatctgtgactcatcaaaaggtaagaggcactgctgaataaggaaatagagtggagactgcctctctatggagtgccatttgagaagacatctgaaagaaagtggagacacaggctacctggaggaagcatgtagcaggcagtgggaacagcaggttaatggccctggtgtggcagtgagcttgacatgttcaaagggcaataaggagggctttgacatgcaacagagtaagggaagagagagtggcaggaaataagcaagagaggcaggtgagggcctgatcacgcatggtgtaggaggtcatcataagaatgtaggattttattctgaatcatagtaaggtgtcattgattaaagaatgtggtcaggccagcagaataagtattaatagtccatgacagtgacagactgtctttgaaaaacattatttcctgagtggaaaaaaaaaaccctagaaactgaagatacagtcaagtatcctatgagtactgaataaatactcttaactcactggtaggtggatgtgtttgaaaatgattactaaggaacatactgtgttattattcaagctatcatgatgggtatagatttagttttttaaagaaagcttcttatttctggaacagttgaataaatttattataatttccagagacccagtccttaagcatggagttattttagtgtaatgccaacacgctcctgtcttggtttaggtgagctttcaggtgtgcaggcaatttgcatgataaattttgcatgtatacatctcctctctcctttgctgcaaaggaagccaagtagtaaacagtctttcttagtaaatgttttgctgaaagaaaacacacatttacaagtcaaatcatgtgaaatctttgataaggaaaggatgatagcaaggtttattttacagtttatgctgaaaattttactgggaagaaataactaggctggttatttccagttacacaataagcagttactttttaagagctactgtgtaaaataaacactgctaagtggttgtaatatttgacttcattcattcattcattcattcatttatattaactaacatctattatatatgtaccatgtaccagggcactatgctaggagccaaaaataaaagaaaaattttaattacagctacaaataatccacagtctagaagaactcaacagagtacattggcttcttctaattccaaataaaaatagggtcagcatatgtcttcacactatgacaattggcaatagactgttaagcttcggctttctctttctatttcctcttctgcctttctgctgtgactttgtaatcaataggactattagcttaactggatacatcagctaataatccaacaggacaaatgcataattcttagaatcagtttagatggttgcccgcagcccccttctactcatcctctgaaaatgctgtagagttcactccagtgacctaccatccataaaccctctgtggctgttcagatgtttacacacattggctacttcacagaaagtcctatctctctgttaaaagagaaagtatatgtggctgaaatgatggttagttctcatttcagtacttggacgtcaagcagttagtttactgttgcttttgtaacttggaggcattccattctatactgaacacttctttggataaagttctcatctttctaacacattgttagattaaaatagtaatggaaaagtaataatctctccagcctacagacagctcttatgccactacatgtctatagtattgatataacatttttataacatttctgtttcagttatctattgctgtataacaatcaacctaaaacaacaaacactttatttccttgtgatattacaatttgggctaggctcagccaagtgcttcttctgttagtcttgtctgaggttactggtgtggttgtataccaccagtcatgccacttggggacactaggacatctgtatttgtctttattcctgtagtctcaggcttctccctctccaagtgtcctacatcctctccacactctctttctgcaagttggatgagcctcagacttctcaagagttccaagacttgttaaagcttagccccagaattaaaatacattacttctaccactttctattggtgaaagcaagtgaaagagccagcctagattcaaggtgaggaaaccacacaggaatgtgaatacttacaggcatggttcagtggaggtctctaatgtaacaactacacctaccttgactcaaataatctgtaaacctgcattagatctttagattgataaagagtttcaggagggtagggtgagctccttaccaaggggccatgatcagagtcctacctcttttgcgttgcatggttccaacaacacttcatttctagaagtcatcttacctttactcatcctgggccctttgtctgggacagcttttctactttctgacatctattgaagtctttcttctcaaaacttcaagctcaggctttatctcctgccagaagcctttcctgatgctttcaggttctgttaagacctgcttctttctttttttttttttttgagacggagtctcactctgttgcccaggctggagtgcagtggtgtgatcttggctcactgcaagctccgccctccgggtgcacgccattctcctgtctcagcctcccaagtagctgggactacaggtgcccgccaccaagcccgacaaatttttttgtacttttagtagagatggggtttcactgtgttagccaggatggtcttgatctcctgacctcgtgatccacccgcctcagcctcccaaagtgctgggattacaggcgtgagccactgcacccggccaagacctgcttctgagattctaaaatatatcctgtgtttatctctttcacggaacttattatattgtagtaaaatgtctgggcatttgtttatgagtttgtttcaccagctagactgtttacaatctgaagtcaggcctgagtcttattaatgtgattttgtcattctgtaagtgcccagtaataacatgttaaaagggaactggaacaggagaagtgtatgttgtataatctgatgtcaccccaaatccagcataattcaatgcatatattagtggcttaataaatattggacggttggttgaatacataaatctatttctgttagtcactacataagagatataaactcttattttggtaacctggtaaattttcagcaagcttcataaacatttcaattcctagctaggaaagaagcaatatgccttgggcacaacttttcaagtaatatcaatgtttagcagcatcaacctttcaggcaggtgtaaatagctaaaaataaaaattcatatccttctgaaatgctggctaaatttctgaaggaatgtattcatgctctgaaacacaaaaccgttctcttgcttctataaaacagaacaaaacctgtgggaaaccaaattactttgctaagtgtgacaaatccaaactgctacagagcaagagataacataaattaatgggtcttggaggcaaacaccaggagttattttgaggtgagtgaaatccgatctccatcctaaaaccacactgtgtttccatggatcaagtttttagttttatgctttttagaaaactatttatgcacaataattacagccacctgaatgccctaaataaacgtagcccagtaaatgcaggcgtgtgcttgaatggtgccctattgctttcaagtactttgtagtgggctgcatgtctgttttgacgattcccccctaaaacctaaaggcagagatgctggaagggtttgcattaccaggtgacacagtgcttgactttgataagccgttgctaaggcaaagaaactcctaaagccttattgagggtagcccgtggaagtctgtcacactgtcttatattatttttctttggatacaagccatttttctaatttaacccttgattttcttgagggcagtaaagttgtcttaggttcttttcacacagagagtgtttagaaatgtttgtggttgaaatgagtacccttctggattatgtttaccccaaaggagatgcattattttattttaatcagtgttaaagataatgtataggaggccattggataccactgagctcttgtaccaggccccccccaaaaagaaaaacaaaccaaaatggagtcactcatgctaaagttccacatcaccaagcaaaatctaagttgtttttctgaccttccaagaaaccaagagagtgcgagatgatggccaaatctctaaacaagccagttttagctggcaggattagaaattcccctttactttatcctttacaaggaaagtaacatttaaacaatcagtctgctttttgttttctatttttgctttcctcagcccttttctgtgtataaaccaatgtcctcttgctcacctcatcataatggtcattttattttagagaatgaggtactgcctgtccagaactgcaaataaaagcttattaagatctttatactaaatttttttgttgttgttgaaacttaatcttttgacaattctggcaaccaacaaagggacccaaatgacactgctgatgaatcccaagacctcttggggaacgcaggagagatgttactgagcccttttcaggtcccctgtcttcctcacggagccccagtctgttcctttcaggttggactccggtctttttgcactgaatctctggagcttatcagctttcatttgggggttactttgtgctgtaagagagcatttgaccttgaggtgccaagggttagtctgtgctctgagaaggtgcttgacctttgggtttgtgctggctgatgagttactggcaggagctgcagttttaaaggtgactgacaacagttgcagtaagtggttattactgcagggagtcagaactccagcttccaaaattcgtagagatttggtttctatcttcttaattgctttgtcttgagcacttagttgaggcatgcctcaggtgtctgacagggtcaggcagaaactggaaaattattggctaagttggtcaaaggcatctcagtgccaaagccacaatttgatcagtgggcatgatttgggcacttgagagctattagagcaacccaccaccaaaagataagactaccatgaaaggataagctgcatgtaaaatagggtagcacctatcagcctctagaaaatgtccgttcaacaaggtacgctgtgaaagcattatataacccaatgtggcacttccctcttaggctttgatttagactctgagagactcaacattcaatataaagatagttcctaatttataaaaaaactgagcactccacctttcagccacacttgccttttacactttattaggccccggaagcttcaaatacttacaaaaatggccaaatcttactaaagatactttagaatgacaatggccattatatagcatgtttcagatgaacaacactgcatttaagatgtgcatatatcaatgagggttctcaaattaggccaaacccagatgtgcagaagtttctaaaaagatttcaaaaaaaaaatttaatgggctcttttcaaagattgttttacagaaatcaagtgaaaagtttaatgattaattgataagaaaaattaaatctactatccttttcatttagttactcttccaccccgaaggtaaaaagaaagctaaagtgtttctaaaggttaggatctcaggtcaagcaggtttgcttcttttttagagctatccataccgagtccaggcacagagaatgttttctttgccccattctctaatgggctccactctggagtcagtaatgtagttaagaaacaagctaaatggaaaatatagcctattgaactagatcagtctctgaagtacacccttctggcatttagctggctatttggaaactttttgtaaaaaatttacatctataaagaaaaatcactagaaattcttaaagtgagagagagtactggtctaaacaagcctgacctttgatgagtttgtcttaactgggcttcccacctacatctttctttgtctagggtgaatggactcttagaagaatgatggttacgacaaggtctgtctggatttgtagatttcctctcctgtgacaaatgttaatcttccctggttgctggatctgtctttaggcaaataaggaagaatattcagaaaaccctgtcttgcattgtgctattctttaagtgccttcagttcaaagtaatcaatataccaaagtgacatattttggggtgcgattttctgaactactttaatggctatgtagtttaagaagcaattcgagcatgaatgttaagaatgagtaaatttacataaatgtaaatggtataaaagtttatagctgaacttgtcatagtttaaaaagtctttttcagtaactttaactcttaaagtcatgttaaattaatagatatttatgaaatatcagtcattcttaacaaaactaaagtattaaaatattaattgctgaacataagcttaaaatgtatacactttgatatcttgtttttatatcatatagaagagctcaacatatttaagtctgttagtaaacatgaaaaaattgttatatgaggaagcacatgtttctagaaagtataaaatttgtattcctaaaatgtttttgacagacagctcaaaattgcttacttcttaagattccactggaagttaaacttactaagggttaaaaattccaattaatatatgaaagctaaaactagaaataataaaggaagtaactccaaatatgagaaaaataagtaatatttttgctaaataaaactatgaggtatgaaagatgtgtttttgttaaggaagaaagagagtaatttttctcctaagtagaatgactagtttttccaaagtagaaaaagtattgaaaacacaactgaatgaataagaaatttgtagacagtttgttgaagatgaatcttgtgaaaggaactctataagggtgatcaagctggctaaaatgagaaaaaatgttatccatatgtttttctaagaattgagtattaatatcaaaagtatactgatataaaactagaatttgatctcctgtgttaaaaccacaaggttttctggaattattgatctgttcttaataggaaatagtaaaaagtttttctttatttttttaggtaacttgcctagaaagcaaagagtctgtactttatcaagatgattctgtgtgctttgtattgtctttattaggtctttgatgactgagaaaactgaatcctctctattaaagagctaagagtttttcctacaactaggtaacttactgtatttgcctttagagtcttttaattattactctggttaaactaatgactataacttcacagtgatctgtgatcctattttgatcaaatgttttaaaccatttgacattttttataaactttccaaaataaactaaattaagtcttcttgaccttgaattaactttgggaaaacctcaaaggacgtgtctctcaccttttaaaagagagatattaaactagttaggcttatttcatatgttaaattatatggggagtgttccaacaattgtatgtaatccctagaaatatatcagtcctaattctggttattgtgctaaaatgttgtatgctacgggacattgaatatataagtttctgataatgttaaggtcataccattggactgggtgagaagttccagaactctggtgaagaaactggaggcttcatgaaactgccaaccaagatcaagcagagcgagatttacttatgtaagactgaaaaactgatgaagaagagttatggttttttatggctttttaatttgaaacattacttgttattttaatgttttattttacagatttaagaaaagcttttttttaaacctatctatagctttcagcaatgtggtaaagtatacttttgtgaacaaaagttaaaacatttactttttcctctctatttgatctttccagaattcagaaactatttgtgaggattcttgtttttatggcaatatggttatttgcataaattcaataagaattactctctttataacatgatacaattggaaatactggttgcattactaaagcattgactgggatgtcatacctgagaatgcacatagaatgactctgtaggtactgtgggtaaagtctgaagtctgccttggtttggtttcctatcttccagaggttttcaaaagtccaatttgagattccttattaaaggttccagcaaaacaaaactcggaaagagcccaagtggtcactactttttctgcatttatgtaaataatcaggccaagttggatgagattaaacttattttgccaacaaattagtctcactccattttttgtaacaatgagggtgactctagagagaaaaattgctttagaagaaaaactgtagtaccactgttactagattgtagcctctttaactattttttgagtttttactatctgcctgtggactggactggatcctgaatttgtctagtttcctccaatatctggctctgaaaacaagacctgctctctttcttaagccctgtaagatgaagctagacaactcaatataaatttcaagaaacaagtctcatgcttgatgtgtgggccatacagagagttcaccaaaatgcccaatattgtaaccagagacattcaaactataaacaaggatgagaacttgatgatttcatgttgtggacagtgacagagcaggagcatcaccatcttggataagcactgtcattttaaagttcaccttgatcaaaaactgcctaaatccaaaggacatcagcctaatggctaaggtcagcctgatcacaaaccacaaataacatctctgaccaaaaacattccaaaccccttcccggcaagagacatgccagccctcatataacctcccctctggccagagagatgttagccccaagataacctcccctctgaccagagacattccaaccctgccataaacttctcccctacacagaaacattccaagcctgtgataaagctctctcaccctaaaactaataaatactcttagtccctaagagagaatgctcctgaccaaaattggccagaagcccctctcaggtttagtctccaaaataaacctttgactgttgagctacttttcgtgtttctttcctctttctttaactcttatatttggtgccaaatctgtaagagagaatgttcctgaccaaaatcagccagaagcccctctccaaaatatttattctccaaaataaaccctgtctttgacagttgagccacttgtcatgtttctttcctctttctttaactcttacagacagcttgtgcccagatgccaaaacaagactctgtatcataatgaaactcttagccctcttaatttttttcttatttatgcctaccattttttgctcagcaggatagacttgtagtaattttataatcagtagcttcttcaagtaacttacaaaattaaatcagattggtcatgtcaaacccagatctttacaaaacctaagggatcctttagtccacccagtgggtaactttggcaatatccctaatgcaattgctgttcaaattgtactagtgttcccttttatagggtaaaacttctagactcacatgtttttactccctgccttgctgacacttcttattgcacatgtataaatatagaaagtattgtagagactccattgcaaaaagttagcaaattggctacttggttaaaatgggtagattccttttctggctcattctttgttctattcaattttagttggtttggttcattaagaccctggctaaggtgcatactccaaactcttggcattcctaatatccttggcattatcgccaaaattcagaaactatttgtgaggataatagcagtctccctggtatactgcattccctcaaaagttttaaatgtttgcatgcagccatctctcaaacttcaaatggtctctattcagctattcagtcggtgtataacactaatcacggtttttgccattaaaagcaatggcaaaaaccacaattattttgcaccaacctaatagaatggcaaaaactcaaagaaatgcatgattatgaggacactataagctatgaatggcatgttgacttcagaaacccagaatggtggtaacttagggctaatgcccctgggggagcatgaccaaaagggggaaattgttaaagaaaatgtataggaagccattggctagcactgagctcctgaactaggcccaacagacccaattaaaatggagtcagtcatgctaaggtgccacatcaccaagccgaaagtaagttgtttatctgaccttccaagaaaccaggagagtgagagataatggccaaatccccaaacaagccagttttagctggcaggattaggaagtcccctctgctttaacctttagaaggaaagtaactttaaaacaaccagtctgctttttgtcatctatttctgctttcctcaactcttttctgtctataaacccatctcctcttgcttagctcatgggaacactgattctactttataaaatgtagtattacctcatcctagcattgcaaacaaaagtcaaatacaatttttaaactgaatttgttataattttgtcttttgacaccaggaaggacccgctccagttctgcctactacttgatcattctcctctttggattaaagctgtgtgaaacacaagaatgatgttgaacacatgacatcaagtggagggcaagccatgctaatttttgtggactggcccattgaagtggtattgagctagaattatagcctgtggccagaggagacctggagctcctttgccttgttattcttcttttcctgggggattagcaacccaagcagacagtttctttccttccaggaaaaccccaaacctcttggtgaagtgacaagaaatattcaccccagcgcacatcttcctaagaaggcccaaggcagaatgctagctctctcagtagttcccaggcaattcaatctgccacaaagtacaatgtagagcactgtgctacagggaaaaacaagcaaacagaaaaggaaaaaagtccattctgcatactgattttgtctaatgtggcatttgcacacttgggcggctacagtacttccgtgctgctgccagattaattcttcccaaacactgctcagatggtatcactcctttggccccaaaccttcactagggttatcgcctaaaaaaggtagcctgggagttaaaagtttgccatggtttggctcaaacttatatttccatgtgtcagtcctattatttcaaattccaaccaacaatcttctataatttttttcgtacttttccatgcctttacacgtgtagagattttttttttttcacttgtaagtcaaaagcctagctaggcatcaaattccaacagctgactttccccctatgcaaacatactctgaccttgccagctgacagaagtatttccctcccctgaactctgctaacactgctttgtcacagcattgcattttctttcttgtctggtccatgtttgttcaatctgctggacctataccagtgcctactgtattatgggtactcaataaatgttcattgaatgaatattaatttttacttattgtggtctttgcattgatggtttctttgtaagccaaatataacatttatactaacttatcatttttgagggtcaaagacaatttccaggtttcaagaaatgagggctctggggtctcttcaacacttgcaggcctagagctggacttgtataccttgagacttccctgctataggcagatgtcattgaataatattagtgtgctctatttacagagtgcctacgcttgtgctaaatcacttcacattcatatccctagttctcctagtgacatactgatgatgcctatctcatttttagaggaaacaaacaatgttcaaagatgaaggtcctttcccagagttgaatgtaaagtgagtaccagcgtcaggattcacacctaggtcagtctggctccaaatctagcttttttcctaccatcccacattccttctttgaattgcttcacagtttctatggaagtttctgctatttctctgtctttgtctctgaggttcatttccactcctgcagcttcacaaaagcccaattacacctgccagtgacctgctttgtctaacaggatttttgatggctatagcgtcatttcagcatccgcacggcctgcttctctctacccagagcacagctcccaggaggtgctggaagcctggcagcgggtcatttcagcagcttgtttttaccacttttcagcacaaactgctttatttcaaacattgctcatcactcacctgcctgcattcccccttcatcttcccttaagtctgtctcataggcctgtaagtagaaattgtggcaactcccgaagtctagcagcactggggaagagtagaaaccttactgtcagacttgctaattgaaaatttggggagaagtccactcagacgtgtctaaagcagattacctttgaagtacttacaaagaaaggttttctgagccttgaggtccataatggggatgtgtatatggagagcgggaaaggagctctttatactcagagagctgaactatttgcaagtgccaaggccttcccttgagtatggttaatgaatcaaatagaaatattatttcaccagttctaacatgcccatttatttttcatcttaacattctgtaatgggaatgtggcttacatagacagtggtagaaccattatttgccaaatagcagtcatcatagttgtttctgccttcacctgagtatcaaatacaccagcaataacatttgcagaataagcaggagcaggggtaggctagctctatgtaattacaaagctcacctaatttagtttttcataggattttagggaatgcttcacatcaaagctgttggtggcacagaggacaatactgtgtggaaaaacttgggcctcaatgaccgagcgaaaattgagtctactcagaagattcagatttggacccagaagaagttttagaaaaatttgaaccaatttacattacttatttttttatgtgtgcccaagaatggcataagattcaaaaaaaaaaatctgtctaaataatatgttagcactctttcactatatatgatataaaaattctagcttatgtaatagttaaattgatgttttcctctgatgtagtttaaaaaaagtttaagcgtacatgggaaataacttatacttttacatcagattggcttgggtttaaatttaggtttcatttcttattagccttgtgatatggtttggctgtgtccccacccaaatctcatttgaattgtagctcccataatccccatgtgtcatgggagggacccagtaggaggtaattgaatcatgggggcagtttttcccgtgctgttctcatggtagttaataaatctcacgagatctgatggttttataaggggcagttcccctgcacatgctttcttgcctgccatcacgtaagacatgcctttgcttctcctttgccttctgccatgattgtgaggcctcctgtggcgtgtggaactgtgagtccatgaaacctcttttgctttataaattacccagtctcatagcagtatgaaaatgggctaataagagtaaactggtaccagtagagtggggtactgctattaagacacctaaaaatgtggaagacactttggagctgggtaacaggcagaggttggaacactttggagggctcagaaaagacaggaagatgtggtaaagtttagagcttcctagagacttgttgaatggttttgaccaaaaagtccaggctgaggtggtctcagatggagatgaagaacttattaggaactggagcaaaggtgagccttgctatgctttagcaaagagactagtggcattttgcccctgtcctagagatctacggaactttgaatttgagagaaaggattagggtacctggtggaagaaatttctaagcagcaaagcattcaagaggtgactttggagctcttaaaagcattcagttttattcattcacaaagatatggtttggaattggaacttacgtttaaaagggaagcaggctattgcttcagagggtgcaatccccaagcctttgtggcttacatgtggtgttgggcctgcaggtgcacagaagtcaagaattgagttttgggaacctccttctaaatttcagaggatttacggaaatacttggatgtccaggcagaggtgtgctgccggggcaaagccctcatggggaacttctgctagggcagtctggaagggaaatgtggggtcagatcccccacacagagtccctactggggcactgacaagtggagctgtgagaagagggccaccctcctccagacctcagagaggtagagccactgacagcttgtaccgtgtgtctggaaaacccacagacattcaacaccagcctgtgaaagcagctgggagcggcactgtatcctgcaaagtcatagggctggagctgcccaaggccatgggagcccacctcttgtatcagtgtgccctagatatgagacatgcagtcaaaggagatcatttttgaactttaaggtttaatgaccgccctattggattttggacttgcatggggcctgtagcccccttgttttggccaatttctccaatttggaacaggtgtatttacccaatgcctgtaccctcattatacctaggaagtaactaacttgctttgattttatgggctcatgggcagaagagacttggcttgtctcagatgagactttggactgtggacttttgagttaatgctaaaatgagttaagactttggggaactgttgggaaggcaaaatggttatgaaatgtgaggacaagagatttggaaggggccaggggtggaatgaaatggtttggctgtgtcctcatcttgaattgtagctcccataatccccatgtgtcaagggagggccctggagggaggtaattgaatcatgagggcaggattttcccatgctgttctcatgatagtgaataagtctcacgagatctgatggttttataaagggcagtttccctgcacatgctctcttgcctgccaccatgtaagatgtgcctttgcacttcgtttgccttctgtcatgattgtgaggcctccccagctatgtggaactgtgagtccattaaacctctttttctttataaattacccacataattcttcatagcagtatgaaatactcaggtatttcttcatagcagtatgaaaatggagtcatacaccctgggaccctgggcatattacaaggtcttaatgagagaataacatttgtagcatgtggctaataattgctatcctgcaagctttattaaatcatttcttttatttgttaaaacgttataaacatttagttttactttagtttttactagaaagttgtaaatacacatttctttttttaaaaaaatctataattttcttttctagttgattttgaagcttcagtatataaagtagcatgtattttacacatgagctttgctgtcacttaactgagtaggaaaaaaccaacagtacaggaagtttgatggagtccaaaatcttagtagagatctgtgggtttccccttaaatattggtgaaaatataggatctgacaaggccctgtcttgtctcttttaagaaggcatagtttgatacaacatcatgccttccaggatttcataactgaattttcatactagaatttttgataggcatatggctgtccagccaaagactacatctcttagcttcctttgcagcttggcgtggccgtgtgactaagttctgatcaatggtatgtgaggaggaatgagctacgcaactttgggtcatgccctgaaaatgaagatgcagtcctcatcccctgtctattgtctgaaatatggatggatggacatagctgaagacattttattgggtcaaagatggaagctgtgtgttaaaggtggcagaagagcaggacaaaaataacatgggccctgatgattttggagccaacatatcaccttggaccaatgactcagacttcaatgtgagagataagcaaatttttatcttgtttaagccactattattttgggcctctctgttacagcactaaaaaatgtacgttaacctctccattttcatgtttctgtccctttcattcactcctccccctgaacaacacgacttaaagtcactcatgtgtgccaatctcataaaaaggcttcttctgagttcctattctgagaacctgctaaatttccttgaaatctagttgccttgaagttgctagtcctcctccctggtgaatggtgtcttgccctaaagctaagccccaatacccatggaaatgttttctcaaaatctggttcctgttcattctgactgcctggatgttccattatgtttcctacctcctcttaagatcctcagcttccttaagttggacccaatactaattataaccttatattggcttttcctttccttgcctatgtgatcttttttgttcatcacattccaccagcaaagtccagaggcagcattttgaatagacctggtcccttttctcaatctctttcagtttttttttggccccagaaaatataactgatcccttgtctccatctctttggcctttgagctgaaataactagaagaagcttgccaaagcatactaatatatgtaagttgttgagtgactactgtgtaagtgtcccattttagggattacctccaatccttataacaaatctaaaaagaggttgtattattccccttatacagatgaagaaactgaggctcagagtgaataagtgtcttgtccaagatgcctcatctagtaagtaatgaatcttcaattaaaacccaatctataatcttttcactatataggctatcttctaagcccaatgttaagacaagggcacagagattagggctcatgaaaaagaagacattctctttgtgagaatgtcctaccatgggtacacagattccaaggatgtgaggggactatctagcaccatactctagaggccatattaacaccaggatgctaatatgaaagtttcaaagcttcttggatgaaaagatgctctccttctaacttctgctttttgaatttaaaaaaagtcatttttctcaccttttctctcctaggattcttctgtttccctgaccttgattgacatttctccctaagtcctctgaattattatggaattaaatggcttattttaatttccctaggtgtctttattgaattctttcacagtgttttatggaaaatatctgattacgaattcatagaacagaacattatgagattctttgctaagtggctgccacagtagtattcaggtcctgaagcctctgcaatctctgtttctgtatacaggctcagaaacaaggaggcaagctaagttccagcatcttgcagttgactcttttatatcacctcctgaacaattcctaaacagaaaatactgtccccaaccccctggaaagattcatgaaatattagaaagcaaatcattttaacacagaagttaagatcttgggttctggaatcaaactgggtttgaatctcactgcttctgtttaaatgaccttgggtaagtttcttaatctcactttccctccatttcatggtctgtaaagtgggagtaacacctacctcacagagtattcatgaggattacatgaactaatagtgccaagctcataataagtgccaacctaaaagttaactaactatatcttttataattaagaagtaggagagtcttgttaaacctagtacaaaataccatagcatgtgaaagattctatgagtacctgcacctcctaaccattttctgacctatatacgtattatacataaacatgaaatcatatgaaaccatgctatttagcagaattcctctaattcagcttgattgacacaaataatccacaatgtggaggtgtcctgagagatcagatgattccttcagagaagagggtgaattctcattagagatctggtagttccagtctagatgagtcaccaatgaatagatttgctatgggttaatgttccgcccagcttgactaaattttaggcaggtttcttcctgactattggctcctaacctcccttttcttagagcatttactttacaaaacttgcaattataaattaggtctctggccctttgacatgtaaatcttctcccagtctctcactgattttacatcctaaaaatgccctttccaaggacctagaaaccatccttttgaaatatgattatcaaaaaagataatgtccttatcttctcatctctgtggaaggataggaggctgatttgataagcaccgacaaagaaacaagattttccttcaaagtaaggaagtatgaagaagtggccttgtagggagtgacagacatggctcagattcaagcagatcatttagtcattatagagaagttaaatattcctctcttacaggttagctgggctttaaaatcacaagaaaaaagtcaaaggttacaggcttttgtgaaaaagtacacaaaaagatgcctttcacaatgacagtcaactcaactctccaagcaatgcctagtttctagaaacttccagatgaagaccagccatttcagtctctgaagtcccaggggtgtgctgggatcttccacccactcagaaagcctctttctaagaattcagtctttgagcatagctgttagctagaaagaaaattccagttgatgtatgaatctatagaaccagtcattctcatgccctctagggataaactaggcatctccaaaccctgaaggaacagagtggtggtgagtggtgttcaaatattttaaaagtattggagtaccaacaaggacatactggttaggagaatatgagctcccaaaatggatattagacacattattattactttttgagatggaatcttgctctgtcgcccaggttggagtgcagtggcacgatcttggctcaccacaacctccacctcccaggttcaatcgattctcctgcctcagcctccagagtagctgagattaaaggtgcatgccaccacacccagctaatttttgtattttgagtagagacagggtttcatcatgttggccaggctggtcttgaactcctgacctcataatccacctgccttggcctcccaaagtgctgggattacaggtgtaagccaccatgcctggcctagacacattataaaggtaaataattataaccatgtgatgttgacacatgagtaaatatgaataaattcagatacctaaagggaatgcagtagaaattaagtaaaaaacaaaatataatttggcatcaagcatacaataaaagtagcatttcttttttttttttttttttttgagatggagtcttgctctgttgcccaggctggagtccagtggcgtcggctcactgcaaactccgcctcccaggttcacaccattctcctgcctcagcctcccaagcagctgggactacaggcacccaccaccacccccggctaatttttttgtatttttagtagagacggggtttcaccatgttagccaggatggtctggatctcctgaccttgtgatccgcctgccttggcctcccaaagtgctgggattacaggtgtgagccactgcgcccggcctaaaagcagcatttctaatcagtgaggatgacaaggactattaattcattcaataatacaggaacaattaaatagtcatctagtaaaaataaagtttgattcatacctcattccttatacaacagtaaattacatagatcaaatatagaaaaacccaaaccataaaagtactagaagaaattataataagattcttatataatctggaagtgagggaggcctttttaataataatacaacattttgaaaccattcatttaaaaaaggcttgattaaataaactacaaagtaattttaaaaatttgcatggtggccgggtgcggtggctcacgcctttaatcccagcaccttgggaggctgaggtgggcagatcacgaggtcaggagatcgagaccatcctggctaacatggtaaaaccctgtctctactaaaaatacaaaaaaattggccaggcatggtggcgggcacctgtagtcccagctactcgggaggctgaggcaggagaatggcgtgaacccgggaggtggagcttgcagtgagccaagatcatgctactgcactccagtctgggtgacagaggaagactccatctcaaaataaaataaaataaaataaaatttgcatggtaaaaatcagtgtaagttaagttgcaagtaaatgaaaaactgaggaaagataattacaacttgtatccattcatggggctatatggctaataagaaagagctcctttgcccttcacatcaatagaaatagaccaacagcagctcccagaatgggccaaggcattttgaacaggcagttcagagaaaaggaaatacaaatggaacttaaacatatgaaaaaaagctcaattttattcataatacaagaaacagcacaaagatactacttttcacctaccaaatatgtaagttccaaaaatttgataatatgctatattggtcaggacataacaaacttttccttatattgctgctgatggtataaatcattgtaactgctaaggagggcaatttggcaatacttatcaaaagtacaaacatccctgaaccagcaatttaacttttgggaatgtatccatcacacatatgccttcatatgtgatgtataaataaggttattcattgcagcattgtttataataagaaaatatataaaccattgttattgatagggagatagttaaataaattaaggtatattaataggattattattattttttaaaattttgcaggcacataaaacattcacacaactaaataccagaaagtgctctatgttctactgtggaaatatctctattaaattaaattaatgggttaaaaaaacaagataaagaacagaatgtagagtatgctaccattttttatatagcttaaaaatgagagataaagagaggaaaaatatatttttatatttgcttgtacctcggttaaatatccctggaaggatatacctgacactgtgtggttgcctattgggaagagaaatgggtatctgaggtaataggtattatagggagatttgcttcactaaacattgtataaacttttatactttcttacattaaaactctcttggccaggagtggtggctcatgcctgtaatgccagcaccttgggaagccaaggcaggtggatctccttgagttcaaaagttcaagaccagcctggataatacggcaaaaccccatctctaccaaaaatacaaaaaattagctgggtgtggtggcccatgcctgtgatcccagttacttgggaggctgagataggaggatcctttgagctggggaggtggaggttgcagtgagccatgattgtgccactgcactccagccagcatgacagagcgagaccctgtctcaaaaacaaacaaacaaacaaacaaaactctcttatatgacatctcatactttgaaatgttcaatttaatcattttccaaatctggaatatggctcatttttattgagatatgaattgttgttgatctcatgcttgatcttcccaaacagaacagaggctctatatctttctctgagaaactttggtgatatttttagcactgaaagtgggtaagaacacttctaacactggaaattcaaagtctgcagcacttactcttgggacttggaaaaattcttttttaaattaataattgttcatcaatggttccattttctttgcctacaagcatgtttcttccttcaaagtggacatgggtgtgtgcatatactcatctgtacacacatacatacacatgtatatgtgtaaggtattgaaagtaaaatgttttcttttaaagtatgtttgcatttttcctagaattggcctcacagtttccatcagacactcaaagcagtgggtgacataggaaaggttaaatattactaaatagtggacattacaattcctagttattcttttcccctttcctacagctaccatttaaatctaggttggcaacttcccttgggtctaaatcagcagtccccagtctttttggcatcagggaccggtgttatggaagacaatttttccatgggcagggcccagggtggaggatagttttgggatgattcaagcacattacattttttgtgcactttatttctattattattacattgtaacatataatgaaataattatacaactcactacaacgtagaatcagtgggagccctgaacttgttttcctgcaactagatggtcccatctgggggtaatgggagacagtgacagatcatcaggcattagattctcataaggagcacacagtctatgcagttcacaaaaaggttcgcactcctatgagaatctaatgctgctgctgatgtgacaggatgcagatctccggtggtaatgctcgctcacctgctgctcacttcctgctatgcagccaggtttctaacaggccatgggctggttggtactggtctgtggtctgggggttggaaatctttggtctagatgaccttgacagcagtatagctggcctgtctgccttcaggctttccacactccacattatatgcccaaccagccagctgttagtaatcattttaaaaataatttactgcctactttatcaaactagctgtgaagcgtttgactgtacgttgaactatagccaagtgtgctgtatttctgcactcatgagtgagcacttcgttgtcatacttcattgtcctggaatttctctgttcctgtttttattagtggggaaaactctgctgtattaattttgttcacagaataaacaaatttttctttaatatataaaaataaactagaaaacatgttttactggtcacttttcaggaagaaatgcctgtatatattttttaaatttttttttttaggaactttccatagggtgaatgatccatgtttgaatataaagtaatgattttattcagtgcttataaactgtattcaattgcatggagaaaaaagaatacactgacctctaatttaaaagtaaagagctttctggagaggtaacagaataataactaatggagctttacagtttataagtgctttcatataaatgacctcatttgtccccaccaaaatctcatgacaaattgtaatccccagtgttggaggtagggtcgactgggaggtgactggatcatggggggtggtccttcatgaatggtatagcaccatctcctggtgctgttcttacgatagtgagtgagttctctcgtgagatctggttgtttaaaagtatgcagcacctcccccttctctctctcttggtcctggtcctgccatgtaagatgcctatgcttctgctttgccttccgtcatgagtaaaaactccctgaagcctccccagaagcagatgccgctatacttcctataaagcctggagaatcatgagccaattaaacctattttctgaaaaaattacgcagtctcaggtatttctttatagcagtgagagaacagactaatacatcatcactgttattttaaagaataaggaaatgaagactcagaaggatgaagcaatgaccaacccaggtcatacagtaggtaagcgaaaaaccagggcctttaacttaaactttctgacactgtatctcataatctttctcatatggtgagtggctctcccaacattactgttacataaaaatttaggtcatgcgtgtaattttatcaagtatccctcaattcctgggacttaagtaattgatacacagaacaggttaaatagagagccttttctgaaagggtaaggaaaaacaacattgatgtttcagaaccaatgtgtgtttatatcatggaaaaagctagaaatcccagtagaaaagtctttacagaagcactacttatcactgtatacctggctatatataaatcataggtagcatactccccctttccctgaattctaatgaaagcattgttccaaatctattacagctatatagtttttataaaatgacccatggggaaaattctttctagagtttaaaagctggaaaagagtttctttctctacacgccttgataatattgttatcaatataatattatataatattataatgacagttctatagcccacttttgtcttgattatcaagaagctcagagtcaagttgtagtcttagttgtagtcatttttcttaatttgggttttctaaaatgtgattgttaatactgaatgtcaatttgattggactgaaggatgcaaagtattgtttctgggtgtctccgtgagggtgttgccaaaggagagtaacatttgagtcagtggactgggagaggcagatcaccctcaatctgggtgggcacgatctaatcagctgccagcgtggctacaaaaaagcaggcagaataaagtggaatgggcagacttgctgagtcttccggccttcatctgtctcctgtgctgaatgcttcctgccctgaaacaacagactccaggttcttcagctttggactcttggagttacaccagtgatttgctaggggctcttgggccttcggccacagactgaaggctgcactgtcggcttccgtacttctgagattttgggacttggactggcttcctcgcttctcagcttgcagacagcatattgtgggacttcaccttgtgatcatgtgagtcaatattccttaataaactccccatccatcctattagttctgtccctctagagaaccctaatacatggattattttctttgttctcctttttacatttttccttttatactatctagttcataccttttactaccgtttcaatggatttttattttactgtaattatatctttttttataagcctcctcaaatctgttttgaagataggcagagtataaacatacagagtccattctaaggaacatgagcatttagtccattgaaagaactaacaatagtataccaggtgcaaatgatctatttaatctcttgagtagcttccagagaagaaatttctgctgtaagtgcacagggtaatagagtcctgttttctttcttttattcttataataaaagtttgacatcactatcacaaccatttcatgtgtcagtaacagtagatgataggtatttggtattatacaacatttgcttgtgttaaaatgagccctggtatttcacgtatgttttatgattgtgcacatttggtgtgatccaaagagataatagtggaattttctatggaaattcttgtttgatacagaattatatcagaagttgacacaagaatcaatgtgtatattgtctagggtatatatcttacatatataattatatcacatctacagttctgattatcataggaatataatacacatgtcacacggacaaacgtattcattttcctaattgatggctacagcagagaaaaccagtgagtatcatctttgagagataaaaccgtggaaatgtcctttgtggtatgattaatactaaaagggaaagggtaattgggtgagaagttagaaggtgaaccaaaggaagactaagaactttttgtaccgtcaataaaacaaatccagacttagacacggtgagacgtaaaaaaactacatcaacctggagaatgttcctcccttaggattttcaagccactcaaaaatcaatcaaaaaggtttttcttttatagggacggctaaacagaactagcagaaacttagaggtaaaattgagtgacagggcggagctaagcagacatcatgatggggatgatataacaggaaatgttgctgtgatcagctaatttggaatgaactgttaaggtagggtgatatagctagtgtttttgttccctagtgtattgttcagtttcacattgaattgtaatcctcagtgttggaggtggggcctggtgggaggttactggatcatgggagtggatttctcatgaatggtttaccatcatccccttggtgctattctcatgacagtgagtgagttctcacaaaatctagttgcttaaaagtgtttggtacctcccccctctctcgcttgctcctacatttgctatacaaagtgcctgctcccgctttgacaccctctaccatgattgtaagctttctgaggcttccctagaacgcgagcagatgccaggaacatgcttcctgtaaagcctgcagaaccgtgagccaattaaacctcttttctttataaatcactcagtctcaggtatttctttatagtaaggcaagaacagcctaacacagtgggatgtttacattttagtgtttgctcagatttggggcaagccaaaagtcaggagcctgtggggaggagagatgtctgattaaatcttgatcaagccaagtcagtgggcaagaaatgggcaattgtgagcatctggccgggatctgcaacctcatgaaaagtatataccatcaaaaggctaactacttgtttgtcacataaattcttataaaaagcttagtggagccaagaagcaagctaagtataataagagaaactcttcttaccatttgtatcactaatgagcacataattgcagctagtcatgtaagtctcctacaaatcagcgtaaggttaattaagagagttgagacacttaggtgaaagtcacttttgcttatagtaaagaacttatctatcttacagacacatatcacttacattatgtatttgttatattaatatatttaatatatttaaaaaacattgtaaaatgatgatctggcaatatccctagaagaacctcattgaaatacttgagatttattggtcatttgtctttacaaaattgagatttgaaaagctttaaaggaggacattctaccaaagcataactcataaaacagaagataaaagtatgagccatggaattatagagctggaaaagatctagccctactgtttcattttcaaatgaggaaattgagggttattctaaggggttgtttttttaagtcatacagtaagttggtgcagacggaggagtagcaatcagatctctgagctcttttcctctttgacaatgaagttcacgaatgcaattttgtttcataagttatttactttactaaagtaaagtaaggtacagctatgatttattgttaaatgagaagaatgagtgtcagagaactgtatatggcatgatttcatgttcttaaaatacaaacaatatttgtcaatctatctatctatctatattgatttatttatcttctatctgtatgtgattgaatgaaattggagaaatgagtggaagcatatacaccacactaacattgaacatttacaagaagggtaaaaaaaggagtaagaaaaaaggaagcaaaatagaatttggtaaaatggtatgtgaaagtgaagattgcaaaacttttatccataaaattattaatacataaaaattgaatgtgcacatagacgaagactagaaagtcactaggatatacatacaacaagaacataaacaaaagaacatattattttgaccaggggtttattaaaaataaaaataaaaacaagtccaatgactcccttttctgaaaccactgaaacacaactattttgactcaaaactgataaaaagatgtaatcatatattcacaaacagtattcacttaggaaattttaccttattttcagcattgatacctataaagttttgtgcttcacctatgaatgtatatatatgtacatatacgtccatataaatattttatttgcttaccattatatttgtttactaaatttggatatacttctttattaaataatttagacaatgaaaataaaattaatgtatactcactgttaaaagcttagaaaatttagaaaaagagagagcagaaaataaaaaccactgataatcttactcagagatatccactgttagactttttgcatatgtcctttcagattttttttgcatgtatgtgtattcaaaaatgggctaatatcttactttattatctgctgctttcatttagtaacaaattatggctatatttctgtggtaatatatatagatacaatgtcattttaaattaggtgtttaacattttatcatcaggaattagtgtaatttcttttttaaattttctattaatggtcatttgatttgattctattttttaaacaaccataaacaatgctgaaatgaatatctttatatgtgcattttttgctcctgttcaattgcttccttaggatatattcctatatgtgatatttaattataaaatatttaatttcctaactccctggaagtttacacttcagtatcaaaaacactagtggatgacaattcctttgctattagaacagaagaccatagaatcaaccaataacagatacaaagtttttctcatgggtaagtgccctacactggtcacttaattcttcattatattttgggcaaataaatttgtatctaaaaaccatctttatgatgatctatgacttataaaaatctactatttatcttacaaattacttccaattacttttacttcttcttctgttgccggtatgaggtcactaatggtagattttagaaaatgcgctaacaattatatgtaaaccatacaattagtattttttaagtgtctacaaagaagacatttgcaagtggtttctagctttattgtgaatgtgcaaggggtatattctatcaagtaagcatcattcctatcctcaagacacttatatatactggaaatatgaaatcattatccatagtttggaaaaatttttcttttaagaaaataatagatggaaaagaaaagagaagtccaaggaaaaaaaaagtcatctgttaagatctgctatgtaccaggaatatagttaactacttccttattaattacagcctcccaataatattgaagtagatattatttattatagctgttttccatatgaagaagtgaaattcagactgatgaaatgatttgcacaaggtgacactgccaataattgatatagtgagattcaaacctaggtgacatacttttgacccaacaaaataagttttcaacaacttgagtgtctcagtgatagaatatattatctctggaagcagtgagcttatcatcatgggaagtatgttagcagatgttagttgatgttggttgatcatatatcagagacatgaaaaatattctactactaatgggcgatttcacttgctcatctccctaggccccttctggagggttagatattttgttgaattgaaaactgtaccatttttaaaccattgatacgtcataagcaaatattagaccacagaataatactcaactattttacacttaagggaaaccaaatatcacaatgaatattatctctaattttagaatactagagaatctcagcggtatttgaaagatcaaaatttatattatgcatgttatttttgcttttaaacactagttagaatgtatggtgctaaatacattttagcgtctgtggtgctaagaacacaatcgtttgattaaacaagatctcttgataaagattagttagcacatgctagcctaacaattactgaaattcacatttttacatgggtatcctattattaagtgattccttagatttaatctatctgaaaaaagtcagtaaaatgttatataaaataataataaaaataaatcctctcttgatttagataaaatagcatgcttgtgtgctaatgtattctactacctaccttccccagttgcttctattaaaaatagtactgtaaaaagaaataaaaatcaaaaatataatatgcctgttgcaaagcgtttcagagaagcttttatgtgaaatttaacagttcatggaacaaagaatatgactggaggcaaggaaaatttctcctctgaaaataagtgaaacctaggtcgtcattagagtttgtgcattcacttttgggacataggatatgttcagggctatgactcatttacatacatgactatgtggcctgtgttttgggagggctgtggggtgttagctgaagccttccatgctggtagttatgctttgctaagagaaggctggttctctacttacaccccctcagatggctctctttagtgcatgtctgtatgatttgacctaacagaaagaagaaatggactagcttctgttattctatgtcagcagcatattttattgaaaggagtatggacttcaggaaaagaaaaatcagggtttgaagcagctgagaagtcaacaagctacttattcttctgagctcttcttcatctataaaatgggcataataatacttcactgagtgagttgttttgagaattgaatacaaaaaatgttgacagtagtaaactgcacatcatctgatacacagttaagaatggagtacattttagcatccttttttttagttctgtaataaggagattgtaaatacatttaaaaaaaaatgtttccctagagtttggtgggtgatattgccacttaggaggatagctatcagctgcactggtgacaaagtacctcctgatgcagacccagagctacataagcaaacatgaggggcttggaagcaacccagacatcaagcaggagcagtttccagggctgtgaagatgtttgctctcctctacttagaaagaggctcttttaggagaaagggacatatttaggagaaagagctctgcctgttcttgcagacccagggaaagaggagcttggatcaggaagccagagagcatttactctgccttagtgagttcctaaggtcctagaaactctctatgggtgggtctctgctgcggtgagggactctgaactgtgacctgcccctcagatcccaggaagaagagaagcaaaagcttagaaagcaaggctgtaggataagtgttagccactgatttcagagctatgtattttccagcaaattgtctaagaactatgctttatctatccaatatagacaatgtactctataataaaattccttaggaattaattttaatagctttcatttataattaaaatctagatggcatttatatattgacaaatgaatacaatttaaccttaagtataagaagaaaatgccagccttaaaaatacattttaactacttaactatttttatacgaatgcacttgagattaatctaatatagtccatatatcttgcagtcagttcaatgtaacaagattattaaaactggtttagaaataggagggtgtttatgagattatctgtcacccttgtattgtgaagcctgagcgcttgattactctgcatgtttgctcttgtgtaatgacaagcacgtcccgtggagccaattactgcctccactttacttaagtgatcctccatcccatcaagaagatattcaacctgattcttagaaaagtgtgagtatttgaagtagttccagtgaaggtggtaaatttcctaacttgaaagcactttcttatgattgcaatgacaatggttaaagaaataaaacttcagaaaagattccacatgaaagcaacttagaatatgagtaattataccttaactacaatcctcagtgatcaaaagataagcaaggtttcccaagcatctttctgtggagcatgcactctaatgagaaagagaagccatgcatactctgataaaaaggcaagaaaattatatttatgaattaccagctatgtttcaggctataaagttgagaattcccaacctgaaaatctgaaatccgaaatgctcccaaatctaattttttgaacacctacatgacaccacaagtagaaaattttgactgtattttgacaagccacagtcaaaatacagtcaaaattttgttttgtgcacaaaattattaaaaatattgtataaaattacattcatgctttgtatagaaggtgtatataaataacaaatgaatttcatgtttagatttgggtcccaactacaagatgtttcattatatatatgcaaacattccaaatccaaaaataattgaaatctgaaacacttccggtcacaagcatttcagataagggatacctaaactgtagtagtacagtgtataatttaatcttgctacagtcttatagggtggttattaaaaatctgagtttctaggtgaggaagttgacatcagggaggtcagaaattgcaaaactgggacttgagaccaggtccatctaacttcaaaacctgttatctgaaaggattctaaaaatgcaaacctgagagtgcatgatgatgtagaatatattatcacatcacatatccagctttgctgaagaacagggtgttctgcacaatatgaggcattgaatataattgaatcctacaccaatactgatttgtttggcatttgagtctgatttcaagtgggaaaacagaagtgttgtttgtaaaacttatgaattaataagttctgagaatcaaaaggactgacctcaaacaaattcaggaaattatatttactcttatttctgtcttagtcctggacagttgacgttgctagataagtttcaaactactacacaattgctgagaaaattggggtggtaggaaaaagaggaaactgatttctattagtaaaactagttgatgacccatagagactgctcaaactttgagtgggttcatatttataggaataaagatgagagacctccaaatcttttcctgatccaataaatattttgtttataaaatatctgacattagaaatgtgtaggggtggggacaacaaaaaaaatgctgagacaaaataggcaagagaatccaaatgtaatgttgacctttgatccttcatctccattgcttaagattttattctcccaattgtcttaagaggtcttaagcaacaaacataagtgttcaaaaaactacagagctctgttagagctaggcatagcacttgacttagtatcctcccaaagcaaaattttgcagatagacaacacatactacataaaacggtgtttcctcttgctcattttaaatttacctcccattaatttcattgcctgtcccttcccaattgtcaagcaaaagcagtatgatcagatttcatcaaaataacttagaccacttaaatcaatgtgtattagacttttcttctttctgtgccagggtactctggaattttatgctctcttttagtaactgctcttctctggtaccaattgactggtgcatttatcatgacctgtattccaactgacacaccacaacaattcctgggaatacagtgaatttaacattaagattgtaagatcagctgacattctaagattcttacagacagggcttacgtgtatttattttggtatgaccacagcagcaaacacaatgtctgcatcacaataggacaaggtgagagctaaaatttaatatgtatctgcatatgttagacttttatgtatatgccatcgtgcatctctacactcatcctctattagtattctcatttctgtcaatggggaaactgagtaagtcacctaagatcaagcagctggtaaataacagagccaagatttgaattcatgtctgtctgactttttttttttttaccatgtgatttaccaaccacactcagtacccaaaatattacttgtggaatgccattttcacagggttgtttatcacacctctaattaaacctacccttgagagggaaaaaactgcaactcagcaaaactgtaattcacaactagcctaatggccaagtggaatggtacatgccatggtcaatcacttagcacgtaagtagtgtgtgatgaagaggtaaaaattgaggcacacacagagccagcctctgttaataacaatgattctttggggactgagtctccactttcattttaactaccactgtagaaaaatgataaataaagtcagtaggtaggatggcaatatgataggtagaaagagaagaaaaaataatttgtgtatttgtttaccactaaaatgcccttaagaggcagctttgtccaagtggcacttttaacatttatttttacttttaataatcatgtgtattatatttttatggctcaatggcactatatgtttgaagaattttagaacattaatatccaatgttacctaagtctagctgtggacttcatgcatgaaacaccattccagcacagaagcactcctagcttgaatatcctcagtattgaggaacttactatcacacggggcagccactctatctttgaataaagatagaatgagtaaagttgataagaaaagaaattcttaccttcacatcaatcaaagatctgtattcttacaatatccctgaaattattctgtaagcaggcctgaaagaattacgtggcaacatatgttgctaggctggttcgttgggttttggcaaagtcctcagtgtttgtcagcatttctatgtgagagaactggctacatagtctatcttggagctaatatcatacttgggtcactaaacatatgtatgaaattttgagaattgtttcttaatttttcagttttaaaatctaatgcaaacctgtatttcagaaaaaaagtattgcttgacctttttaaaaattatcacttaattaacatggggcccagccgagttagaataacttctcacttgttccaacataagagaaacaagcaaggtactcctaccagggtgtcacttagacctgcatattctttttagtgattgcaatgttacttcttagccacccaggccaatccaccataaaacaatcattctccaactttcctggtcttaagagtcacttggattgcttgtttaaaaggcatatttgttgagctctgcctccagaaatactgatttagtagcatggagccgaggaatcttcatttttcaccagcgctggaagtgattctgatgcaagtgatttgtagaccacattttgagaaaaattccctaatgttagcagttgtaatgatgcaggtagttcattcagttttgcttcagtacaaaactgcaaggataatactattgggttttctagatataggatcatgccatctgcaaacagggatagtttgacttcctctcttcctatttggatgctgtttttcacactgctgtaaagatactacctgagactgggttatttataaagaaaagaggtttaactgactcgcagtttcgcatggctgaggaggcctcaggaaacttacaatcatggtggaaggcaaaggggaagcaaggcacatcttacatggcagcaggagagagacacagtaaagggggaattgccacactctaagaccatcaggtctcgtgagaactcacccactatcatgaaaacagcatgctgggaaccaaccccatgatccaatcacctcccactaggtccctcccttgacatatcaggattacaattcaagatgagatttgggtgggaacacagccaaaccatagcagatgccctttctttctttctcttgcctgactgcactggccagaacttctgatactatgttgaataggaataaggagggcatgcttgtcttgtgctgattttcaaggagaatgcttccagctttgaccattaaaaagaatgagattatatcctttgcagggacatggatggagctggagaccattatccttagcaaactaacacaggaacagaaaaccaaattctgcatgttctcacttataagtgggagctaaatgacgagaacacatggacacacagaggggaacaacacacgctgatatcttttggaggatggagggtgggaggagggagagagtcaggaaaaataatgggtactaggcttaatacctgggtgatgaaataatctggacaacaaacctccatgatacaagtttacctatgcagcaaacatacttgtatccctgaacataaaataaaagttaaaaaagaagaaaattgcaaggatggtaagatttggggctctttcataacttttcaaatatgtcaactgagaatatcaaaatgaatcaccagccttttttgtttggggtgtgttcctgtgtgtttgtcacaaaattcacatacttttcaactgtgcctgccttacactaaaatagtcattatacccagctgtataggcccagctatatacatatatatgtatatatatgtgtgtgtatgtgtttgtgtgtgtctgggggctccacacacatttggtgtcaatactgaagtaatgcaaatatctctgtattggctacaaaactcaaacaagaaaaatgaatagatttggatctgatatggccttccactttggctctgaactttagttgtaaggaagaaaataatacttagtaagagtaatatataaaatagtgattgtaaaaccaactatttgtgaaatagtctgccaagtattatgggatacataaagatgattaacacacagttcttgcaaaattggagcccacaacttagcagaagttgttaatcactttggtcaggtgaatgtttcactgaataagaaatattagtgtattaagtcatcagattctttaatgctttgaagtgcttcatactgagctctacataaaatagaaacttcgtgtgtgtgcatgtgtgtctatatatatacatatttgaagacagggtctcactatcttgccaaggctggtctcaaacacctaggctctagcaatcctttggcctcagcctcccgagtacctgggactacaggcacatgcctagcacatagaaaaacttcactggtgtccaaggtggctgaataggaagagctctggtctgcagttcccagtgagatcgatgcagaagatgggtgatttctgcatttccaactgaggtacctggttcatctcattgagactggttggacagtgggtgcagcccacagagggcgagctgaagcagggcggggtgttgcctcacccaggaagtgcaaggggttgggggatttccccttcctagccaagggaaactgtgacagactgtacctggagaaatggtacactcctgatcaaatactgcacttttcccacagtcttagcaactggcagaccaggagataccttcccttgcctggcttggtgggtcccacacccacggatccttgctcactgctagtgcagcagtctgagatcaacatgcaatgctgcagcttgacggggggaggggcatccgtcactgttgaggcttgagtagctcacagtgtgaacaaagcagccgggaagctccaaatgggtggagcccactgcagcttagcaaggcctactgcctctctagattccacctctgggggaagggcatagcagaacaaaaggcagcagacagtttctgcagatttaaatgtccctgtctgacagctcggaagaaagcagtggttctctcagcacagcgtttgagctccaagaacagacagactgcctcctcaagcaggtccctgacccctgtgtagcctgactgggagacatctcccagtaggggccaacagacacctcaaagaggtgggtgctcctctgggacaaagcttccagaggaaggatcaggcagcaatatttgctgttctgcagcctctactagtgatacccaggcaaacagggtctggagtgggcctccagcaaactccagcagacctgcagctgaggggcttgactgttagaaggaaaactaataaacagaaaggaatagcatctacagcaacgaaaaggacatccacaccaaaaccccatctgtataggtcaccaacatcaaagaccaaaggtagataaaaccaaaaaaatgggagaaaccactgcagaaaagctgaaaattccaaaaaccagaatgcctcttctcctccaaaggattgcagctcctcgccagcaagtgaacaaaactagacagagaatgagtttgatgagttgacagaagtagccttcagaaggttggaataacaaactcctctgagctaaaggatcatattctaacccatctcaaggaagctaaaaaccctgaaaaaaggttagacaaatggctaactagaataaacggtgtaaagaagactttaaatgacctgatggaactgaaaaccaaagcacaagaacctcatgatgcatgcacaagcatcaatagctgatttgatcaagtggaagaaaggataacagtgatggaagatcaaataaatgaaataaagcaagaagacaagattagagaaaaaagagtgaaaagaaatgaacaaagcctccaagaaatatgggactatgtgaaaagaccaaatatacatttgattggtgtaccagaaagtgacagggagaatgaaccaagttagaaaacactcttcaggatattatctaggagaacttcccgaatctagcaaggcaggccaacattcaaattcaggaaatacagagaacaccacaaagatactcctcaagaagagcaaccccaagacacataatcatcagattcaacaaggttgaaatgaaggaaaaaatgttaagggcagccagagagaaaggttgggttacccacaaagggaagcccattagactaacagtggatctcttggcagaaacattacaagcaagaagagagtgggggccgatattcaacattcttaaagaaaagaattttcaacccagaatctcatatccagccaaattatgcttcataaatgaaggagaaataaaatcctttacagacaagcaaatgctgagagattttgtcaccaccaggcctaccttacaagagctcctgaagaaagcactaaacatggaaaggaacaaccggtaccagccactgcaaaaacatgccaaattgtaaagaccatcaacgctatgaggaaactgtggaattaacaggcaaaataaccagctaacataatgatagggtcaaattcaaagataacaatattaaccttaaatgtaaataggctaaatgtccctattaaaagacacagactggaaaattggataaagagccaagacccatcagtgtgctgtattcaggagacacatctcacatgcagagacacacataggctcaaaataaagggatggaggaagatctaccaagcaaatggaaaacaaaaaaaagcacggattgcaatcctagtctctgataaaacagattttaaaccaacaagatcaaaagagacaaagaaggccactatataatggtaaacggatcaattcaacaagaagagctaactatcctaaatatataggcacccaatacaggagtaaccagaatcataaagcaagtccttagagaccgacaaagagacatagactcccatacaataataatgatagactttaacaccccactgccaatattagacagatcaataagagagaaagttaacaaggatatccaggacttgaactcagctctggaccaagcggacataatagacatctacagaactgcataccccaaatcttctcagcaccacatcccacttattctaaaattgaccacatagttagaagtaaaacactcctcagcaaatgtaaaagagcagaaatcataacaaaccgtctctaaaaccacagtgcaatcaaattagaactcaggattaagaaattcactcaaaactgctcaactacgtggaaactgaacaacctgctcctgagtgactactgggtaaataacaaaatgaaggcagaaataaagatgttctttgaaaccaatgagaacaaagacacattgtaccagaatctctgggatacatttaaagcagcgtgtagagggaaacttatagcactaaatgcccacaagagaaagcaggaaagatctaaaattgacacgctaacatcacaattaaaagaactagagaaacaagagcaaacaaattcaaaagctagcagaagacaagaaataattaagatcagagcagaattgaaggagatagagacacaaaaaatccttcacaaaatcaatgaatccaggagctggttttttgaaaagatcaacaaaattgatataccactagcaagactaataaagaagaaaagagagaagaatcaaacagatgcaataaaaaatgataaaggggatatcaccaccaatcccacagaaatacaaactaccatcagagaatactataaacacctctacgcaaatgaagtagaaaatctagaagaaatgggtaaattcctggacacatacaccttcccaagactaaaccaggaagaagttgaatctctgaatagaccaataacaggttctgaaattgaggcaataataaatagcctaccaactaaaaaaagtccaggacaagacaaattcacagccgagttctaccagaggtacaaagaggaactggtaccattccttctgaaacttttccaatcaatagaaaaagagggaatcctccctaactcattttatgaggccagcatcatcttgataccaaagcctggcagagacacaacaacaaaagagaattttatgccaatatccctgatgaacattgatgtgaaaatcctcagtaaaatactagcaaactgaatccagcagcacatcaagaagcttatccaccacgatcagattggcttcatccctgggaggccaggttggttcaacatacacaaatcaataaatgtaatccatcacataaacagaaccaacaacaaaaaggacatgattatctcagtagatgcagaaaaggcctttgacaaaattcaacagcccttcatgctaaaaactctcaataaactaggtattgatggaatgtatctcaaaataataagagctatttatgacaaacccacagccaatatcatactgaacgggcaaaaactggaagcattccctttgaaaaccggcgaaagacagggatgccctctctcaccactcctattcaaaatagtgttggaagttctggccagagcaatcaggcaagagaatgacataaatcaattagaaaaagaggaagtcaaattgtctctgtttgcagatgatatgattgtatatttagaaaacccaatcattttagcccaaaatctccttaagctgataagcaacttcagcaaaatctcaggatacaaaatcaatctgcaaaaatcacaagcattcctatacaccaataatagacaaacagaaagtcaaaacatgagtgaactcccattcacaattactacaaagagaataaaatacctaggaatccaatttacaagggatgtgaaggacctctttaaccagaactacaaaccactgctcaatgaaataaaagaggacacaaacaaatggaagaacattccatgctcatggataagaagaatcaatatcgtgaaaatggccacaccacccaaggtaatttatagattcaatgctatccccatcaagttgccactgactttcttcacagaattggaaaaactactttacaattcatatggaaccaaaaaagagcctgtggagccaagacaatcctaagcaaaaagaacaaaccaggaggcatcatgctatctgacttcaaattattctacaaggctacagtaaacaaaacagcatgattctggtaccaaaacagatatatagaccaatggaacagaacagaggcctcagatataacaacacacatctacaaccatctgatcttcaacaaacctgacaaaaacaagcaatggggaaaggattccctatttaataaatggtgctgggaaaactggctagccatatgtagaaagctgaaactggatcccttcctcacaccatatacaaaaattaactcaagatggcttaatgactttaatgtaagacctaacaccataaaaatcctagaagaaaacctaggcaataccattcaggacataggcatgggcaaagacttcatgactaaaacaccaaaagcaatggcaacaaaagccagaatagacaaatgggatctaattaaactaaagagattccacacagcaaaagaaaaggcaacctacagaatgcgagaaaatttttgcaatctacccatctgacaaagggttaatatccaaaatctacaaagaacttaaacaaatttacaagagaaaaacaaataatcccatcaaaaagtgggcaaaggttatgaacagacacttctcaaaagaagacatctatctagccaacagacacatgaaaaaatgctcatcctcactggtcatcagagaaatgcaaatcaaaaccacagtgagataccatctcaagccagttagaatggcgatcattaaaaagtcaggaaacaacagatgctggagaggacgtggagaaataggaatgcttttacactgtttgtgggagcataaattagttcaaccattgtggaagacagtgtggcgattcctcaaggatctagaactagaaataccatttgacccagccatcccattactgggtatatacctaaaggatcataaatcatgttactatgaagacacatgcacacgtatgtttattgtggcactattcacaatagcaaagacttggaaccaacccaaatgtccaccagtgatagactggattaagaaaatgtggcacatatacaccatggaatactatgcagccattaaaaggatgagctcatgtcctttgcagggacatggatgaagcaggaaaccatcattctcagcaaactgtcacaaggacagaaaaccaaacaccacatgttctcactcataagtgaacaatgagaacacatggacacagggtggggaacatcacatgcaagggcctcttgcggggtggggagctgggggagggatagcattaggagaaatacctaatgtaaatgacgagttgatgggtgcagcaaaccaacatggcacatgtatacctatgtaacaaacctgcacattgtgcacatgtaccctagcacttaaagtataataataaaaaaaagacttacaaccaacagagagtttgaaatatatttaaattaaaagtattattaaaaaattctaaaaaaaaaaaagaaaaacttcactggcatagtaaaatagcacatgggaaaaaatcctctcaatttgctaagtcaatattcttataactgatgttgcttatatgtcattgttgttagatctgagagtggaaggaaataatttgtagttattgttataatgaaaaaaatgcaattatctaaagattcctatcattttctcactactccttaagcacatttattcattataatgtagaggaaggttgccttacttgtggtctcaccattcatctctttaagttcgttgttgattccaacatctatggaactcattattttgtcaatctgtaagaaacaaaaaccatttaaatggattgttacattcacttttaacattgtattttaaaataagtttcaaatgaagggagcaaatatttttgatgttattaccacagtgttccacagttaagagatgcatagcgaaatatttaaaggaaagcaaacatctttcggattgttttattaaaatgtaaagtatgttcccctttcttaaactttcaaaattagtttgccttttctttgtgtttcttgaaataaactttgtacttggatagattggtcatttaggaactgtgtattcttcaaactcagaaggactgtagataaattcatgtgacaaagtctctgctctctggcacccttcttcttctgcctaagaacatgcatcccatctaactggtaaaggagcaggtttcagggtgtggagagcacggccacaggagcaaagttttctgttttttgtttcgacagaatctcactgtgttgcccaggctacagtgctgtggcaccatctcagctcactgcaacctccgccgcccaggtccaaatgagtctcgtgcctcagcctcccaagtagctgggattacaggcatatgccaccacacctggctaatttttgtgtttttagtagagatgtgattttgccatgttggccaggatgtttctgaactcctggcctcaagtgatctacctgcctcggcgtcccaaagtgctaggattacaggcatgagccaccattcccggcctggagcaagttctaaccaaatggtttgaccaaccacaagctgattactgacatccaatcaccagcatctagtcatgaaaacaacttaattataagatctaagttaaatgttaattaatcctgcctctacaaaaggatctcagatgttattcactaaattaataaatataagaaatggctatacttgaaaaactaaccatctactagtatggaatttaaaggaagatatgatggtctaagctatagcaatttatggcttaatgactctcttgatgttagcaacctgaataagatagcaggtttcagaaaggacaatgggcattacttaaatgtcccagtttgttcaccctgaaacagatgcagagatattaagtgattttcccaaacagctcagttcagaatatcactatcagaccatatccatttctagttctccaaatactataatgatctattgtgcttctaaacctaatccaactggtacagtcttttcagagacaatatgtgatgtgttagaatgaaataccaagagagactgtatgaaattaaacactttaagtagaactgaaattggtgatatttgaacctcaaacatttttttctttatttccctgatagctgcaaaagggaaatatcaaatgatgtgtgtttattgtatggtggctggagaagagctaggaaactttatttactatgaagattctaaggagctcttctgaaaatataagatactttaaagaagggagacaaactaacaaagagtttggcaagtagcaaaacaacacagagcaaaatactgagctttttctcgatttgtcagctgcagtgcttggtaggacgagatgtgaatattctcttgtacctcatagctagttattacttctgcttgatatcaatttctatggaaacaatagattaacccacatgtgtggaacagtgtttgtttttatacttgctgtgaaattaccatgcattacccacagaaccatttcattccagttggagccgtatgcttttttttttcttgcttttgaaagagctaaaaagctgaaaatccttcccccaaacctccctcaactgcaaagccttataggatgaacagcaagaagaacaaagcttacttcttcccattccgatgtgaaggatggtgttctttcagaattccctttagaactgtgttcagcagtggaagattcactccagttaactcttgatgttttctcattggaaggataggcaatgagatcagaatcagatttagagacactttttgacaaatgcatgtcgatcaaggctttaggcaatgaccttattctccccagagtacaggctctctccacaaatccccctgcgttcataacccactggtccccattccgagatccactcctggttgatcttgtgccaacaatggtatggttttcgagttggttgctttttttgtgaaaaattgttctactgaccactttgggtttaattttctttaccaaaggttctgagttattttctattggagactgcttgaaaggcaaaggactgtttgccaaactgacttcatcttgtcctttttcacattgttctcttttcccatagagatgaaatggattttcaggggactcacaggctggagaggatccatggagcaggcctgcaaattgcccaggatcatattcttttgggggatcattgtcatcctgtcgggagaggtcatctgcaaaaggaaggaagggatatcagggtttataaaggttctgaaagccacgatataatagcagtgcccttatgaacatgtgggctatccaaacatttcatttactgctacatagcaataccttcactttatgaaatacccctgaccccacagtgccatgtatagaatgaatgtatgagtgtgtgtgcgtgtgtatgcatgtgtgaatcattctttctgatataccttagagttcatttcaaaagtatgaattgtgtattaattgaatgacttcattcacttctcccttgaacccagggtgtatgttttatagccaatgaacaaaattgggttttcttaaagtagaacacacacatctaaactctcacagtaaatgaatcatcgtgaagtagaacactaggcaggtaagtcaaggtcatatataatgacaaccctctgccctcctcccagcaaataaattcaaaaaccaaattttgaaaaaaggtattattaaaagtaattgaagtttaataatcctgatattaccttaaatataaatttaaaataattctatgcagattacataatttagacaaaaaaaatttgttcagacttaacaaaggcaaacaacgcagtatcagaaaaagagagactccaatataagaaactaatgtttagctatgaacacaaaggtagctttttctttcttctctgaaacggcattagctattttctaatttcttcagatctttgaagatgtaatgcagaaaagaaaccaatgatgaatgataatttttattcctttggatttttttctaagataaaacacacattttctctgagatttaaaatacaccatgctttttgcgacttaatttgtctttcaaagacatactgtgtaaaaacctggccaaagaatttagcaaagaaaggaagtgtcctttttttcagtgttcattttaattcatatcaatagctaaatattgccaagatgaaaatttaaattacctgataagcccataactcactgttgcaaagaactaaagtatagtaaatgtggtacataatgacaacaaatccaaagttgatgtgctgattcgtactttcagtaagttaattattaccataaaccccaaacactaacatttttataaattaacaagtaacatttaatgggtaagtgttatttactaggcactgaatgaggaattatatcatctcatttgacacccataacaatcctatgaagtgattattaataataattatgattttgtgatggaacgagatggccaaaatatcgaattctcacatttttaagaaattggcaaccataataaatcttattagacattggctcagaagatgctacaggcacatctgctctttatagtgaagattggccccaggtgtctatactgctctccgcctgggaactggtgaaagcaggtatattcctagctatgtatctctagacttcaccctggttcctgcttgatttttccaaagagaagatgtttgcctgcccagctatcataccagcatcctgagattgaagaaagaagagtgacaggaagagagatccaagacacatgaatctacaaatgcaacaatctgcatccatctactactattatactcactgtcttctcacaaaaacaaaacagaacgataaaacctcatcactttctaaaatagccacactgtcttgataactctctattttattttcctttcacaacagagaccattctaggggtagaatagtgagtggatagtgggataaggcagctttcaattctctccaaagactagagtttatcactgagtatgtgcatttttaagaagtcaaaactaacacttagacaacttaagacacagacatttccccacctagtaagcaattaagctgagattcaaattaaggtctatcagattctgacatccattggccttgcaaatatattgctattaaagataagctttaaaaaaatctagggttggtttatccataggacaagcaagtaggctctttgtaaagagacatgcttctcctgttcatgactgtatctggaatttgggaaaagtggactaaaagcatcagagctttttctttgttttgttttgttttcttcttggagataagctaatactaagaagaaaataagacctggcatcttgttccaatgcattttttttcttaggctacttggatctcacagagtgctttacaacataagcaggttggtatgggtgacaataatggggattaaggtggtaggaaggaggaattctgaaataaggaagttttagaatttcattttgaaagttgctgaagaaggataaaaggtctgaatttgaaaggaaaattgaaaagagcttgcctattgtgggaaaaagattctgtaaatctcagccaaaagagtttccgacgatgttcattatctagaaaaatgagaattttaggggcgtaatattatttaaagttttctgcaaatattattattaggttaccatcccctctgtagtttgactacaatgactataattaccaccccacaatgctttacactgtccaagtcctccaatcacaagcagtcacttctcaaagtaaaagataatttcattgttagcttataaagcttagttttttgaatagcagttcttagcattgtgatggtaacatttctgccaagagtggtgaaaagacaaatattacttgctttttccagtggccaaatcctaaagattattcaagtcaaagaaaaggagaagttgatatgaagcctcctggaaagcctgtgtggtggattgattgcagttatggccccagtctgctcacagctccctgcagacacagccctccccgtatctagtcctctcacgctgactccctcacagcgtggccatgtgccttgtaccgctcaatcagactgcagcaaatgtgatataagcagagacctctgaaaagcatgtgtgcattagacttgttcccttgttgctcttggaaccctgacaccatgtgaacaagccaggctggcctgctggatgatgaggtgacacattacccagctgtttcaaaatgtaggttttattatatttttcaggtatgttgaaaccaacagatcaggagacaattgccattgaaagatagacgctctactcattgatccgagaggcatgccacattataggggccacacagggaactaccagggtccatcaggaggaggctgacaaagtgaggggagattgtgggcaagagcctttactatggtttccatgaaaagaaacacacaaagcaggtataagcaggtttaggaatggctagtttgaatagtttcagcagactctggggcataagaactgtacctagttgtctggtcattagagcaggtgaatgaatagtggcctagagagtgagagccagatgaaggaggtaattgggactatgggctctacgattgttagtttgcataagaaaagcatgctctctggtgagctgtttactatctctaggaattagctagccccaggaggggccgtccctccacagcaagagctcaagagaccaaagcataaaaataaaaatacacaaataaaatagaaaataaaaagacatggttaatacatccgccagtcctgtcaccccaaccaaaagccagccaacttccacctatgtgagtgagggcatctaggacctaccaaattcaggccattctgccaataccaccgatgcatcagcaagcacagctaagaggagctgaggttttcccaggccagaagaagacacccaccaggatcatgagcaatattaatggccattaagtttgggagggtttgatatatgaaaatataaactatatcccaagttttaaagaattaatatattcttcaaaataaattctggcaatgtttatatttccacatctggaaaatgatgatagtaatagaacatacctaaaagtgctgtgaagattgaatgaaatcatagaataataaatgtgttagtccatttgggctgatataacaaaatttcataaaccaggtagcttacaaacaacagatatttatttctcacaggcctagaggctgagtagtccaagatcaagacacctgcagatttggtgtcaggagagggttaattttctggttcatagagggcaccatcttgcctgggtcctcacatggtggagggagcaaaggagctctctggagtctctcttataaggtctctgtcctcatgacttaatcacctaccaaaaggcccacctcctattaccatcactttgggggctgggatttcaacatatgaattttggtagaacacaaatatttggaccatggcaagaagtaaaacagttagaacaatatatgctgcatagaacactaagaatatgtttctactattataacaataatttttaatctatagggtttcatttttataaagaaatacagtaataactgtattagacactcaataaagattattttgacataataatcatgtgggatttactcctttgtttctgtttgtatattttaaaaagtatactttggaaagaattttttgtgttttcttaccctttcttcagacaaaacggaggaaaatatacagattaaactgttgtcataacttgtctcatttaattttacacttctcttttgataagtggatatttcatgccaaggtacagaactaaatatgtgtgaattccaatctgatagttattcaaggcatcattagcatttcaaagaaatgtcagagtaaatgtccaataggaagcagttcaatctctttttatccacctttgctatgatttttatcacctatatatcacctgattaacaataaaatccaaaatttcatgctatggaaaaattatagaaaacaagttacttttttctattatagagtataacttttgtctattgggtcattgcatctgatttagaaaataaaaatttttcctatttttaaggataccggggctgatgttgatattagtagaaactgtgaatttatttcacaaatatgtataaaacgtttcctgtatatcaggtggcaaagtttcagcagtgtcaaaggcaatgtcctgccttcatggtgcctacattccagcagaaaagatgactacaggcaaatcaagaaatgctataatttctgatgatggtatgtgctgtgaaaaaaataaagcaaagtaatgagatagaaacgaaaggaagatgctataaggcaattaggaaatgtctttctcaggagctgacattgagcagacatagaaatgactgtgaaagtgtaaatcattcaatgttttgggggaggattatttcaaggcataggaaagaagatatgaaaagtccctaaggctggtaagaacagtaagaaggccagtgtggctataatagagtggtaggggattagtagaatggctgacgattgaatcagagatgcaggtaggaatagggttggggtgatatgacttatacttttagaagataattggtatttctgaacatgacaacagcatagtgttctttttaaattattcacctcaattctcataaaaacaagacacggggatagtaaaagaataaaatgagcacatgatagcaaaataaaggaaaaacactacaggtgatatctccagtaaagctaagtattaagaagtccccatggccccgaaacacagaggggtgtagccaaatcacatgacagcagtaggatccggaactgaatcagcagtgatgcagctatagtggtgaagagaaagggaaattcaatggcacctacaagccatggaacccagaaattgccatcagatactgatttcccaaaggagagggtcttgtgctaagcaggagtgtgcagtaaaatttgagaacaactagcagaacttgtacacatcttgtaacaagaccacaggaagtagcttactcccttgagaatatcagaaatctccaataaatgcatacttgtagtaggctacagatccactctgaagaaaaacttctgggagaagaatacaaattgcacagggtgaaaacaccaaagatgtgagggagaaaaacatttcatataatggggcagtaggggccaggtgcagtggctcacacctgtaaccccaacagtttgggaggccaaggcgagaggatcacttaagcccaggagtttgagaccagcctgggcaacatagcaagacctcatctgtacaaaaagtgtttaaaagaaatttaagcatgataatgagtgcctgtgagttccagctactcaggagactgagatgggaggattgcttgagcccaggagttcaagtctgcggtgagctttgatcatgccactgcacttagtctgggcaacagagtgagaccttctctagaaaaaaaaaaaaggcagtgggggtggcatcaggcagatgtccagtagagggagactttgaatgtaatagaatagcaaagcacagtgttcagatgtgagagcaccactttggaaggcaggcgcatggaactcaagaacactgaggtagtagcaggaagccttcctgaatcaagcagagaaaaacctgtatttcttaatacttcatcgtaactgcaaaggagaaggcccttgagatgtgaagggctcatggctactgtggctcatccctgctcccatacaggaatctcttcctaatccatgacatcccttctcattaaacgtgggaaacaaaaaaggatttagatagagggcaattttaggaataaaataaataatgacagtaatggattataacccactgaataaaacagaaagacacgagcccataaataaacaaatgatttaaaagtttgactaggaatgggaatcctaaataatttcaaattgcctccccacaaaatacttattaattagaaagaggaaaaagagacacgctacagtgaagaaatctgggaggccctatcttaatcaaatgatcaaagtgaacaatatcagtaatggaacaaatcaaaatcatatccagtgtggtaaagatgcaatgagaaaaatgcagaatcacttttggattttcctgccaaagatgtacaacctaaatctaattatataggaatatcagaaatatcagagaaatccaatttgtgggccattctacaaaataattggcctgtaatcttcagaagtgtcaaggtcatgaaagtcaaagaaagtcaaatgaacccttccaggctgaagaaaactaaggagacattacaactaaatgcaacgtgtgatcctgaactagatcctttgatcataaacaatattattgggtaaaccagcacatcttgaaggaggtctgaggaatagatgctagtgatgtattaactttctgatttggttgcacggtggttctgtggttgtgtaagaatgtacttgcctgtagaacatatacactaaattagtagttatcaaagtgtagtccagggatgcttggggtctccaagattatttcagaagtttcatgaagtcaaaacaattttcagactaacactaagacattatttgcccatttcactttcattatctcatgagtgtacagtagagttgttcagaggctacatgatgtgtcttttcacagtggaaatatgtgatgcctctttctatctcagctgtaggaactggcacgctattacttcttgacagaagaaagtcatatgtctaaacctaaagtaaatggagtgaggatgtaaatggccacctatgctactgcactgcaatgtaccatggcagaagagagagtaaagaactgagaacagtaatctcatcttaaaaataatgtttgctctaagttttgggtagatgccctttattaagttaaatgtcttatcttctaaggttgctgagaattttaattgtgactagatattgagtttataaagaatgtttttctgcatctgttcagttatgtaatttttctcctttactctgttagtgtgaatgacatttgtacattctctaatgttaaacattagatattaatgggataccaacaggataaactcagtgtggtcataatgaactttctttttggcatcctgctagatttggtttgttagtactttgggatctttccatctatgttcatgaaagaaataggcctttggttttaccttttttattctgtctagtttttacatgattactcacctcacagaaatagttggggaaaatttccatttccctagaagagtttatataagattggaacgatatgtttcttgaaagcctttatatttactttacctttaaaatcatctagactcaacatattctttgtggaaagatttcaaattattcattaaatttatttagtatagaactatctggagtctctatacctttttgaagttttttaaagttttaattatctagaatttgtctaatttttctcagtattaaaattcactggtacaaaattattcattcttctttcttaactttgaatggttttttgtatctgtagatttacccccttttctttcctaataggtttatttgtgcctttttatcttgatcattttgactggaaagtgcatccatttttttagtgtcaccaatgattccatttctggctttgtgaattaatattacatatttgttttctatttcattcatttctgtcctttactattttctttctatgccttttctggatttattctattatttcttataaaatttcttaagctggcatttacctcattagtcttcagcgtttcttcttttctaatatatgcatttaaaatttctaagttccactttatgctgcattcatcacatttgatatttagcatttatatttttgtttaactttaaaggtttttaagttagtattatggcatctcctttaactcatttctcatgacttatttagaaacgtgtatttaaattcataaatatatggggatatatatgggaatcttaatttaacttaattgaattatttttagaaaatatagtgtgtatgaatatgagtctttgacatgttgaaacttgcttatagtcaagatcactttttgtgactgtttcatgagaattacatgtattctccaattgttgaatacaaagctctttgcattatgtcagattaaatttattaatggaactcttaaactcttccattgagtgaggtgtgttgaaacctaattttagcagacttatgttttttcctatgaaatatatgtatattatatctggccaacatggtgaaaccctgtctatactaaaaatacaaaaatcaactggctgtggtggtgcgtgcctataatcctagctactcgagaggttgaagcaggagaatcgcttgaaccagggagttggaggttgcagtgtgccgagttcgtgtcactgcactccagcctgggtgacggagtgaaactccatctcaaaaaaaaaaaagaaaaaaaaaagaaaaaagtctaaagttaaataataccttatccacttccttcctaaacaatttaaaaactttagagcattttacattcaattacttcttctataataaatattgttgtcagtgttttaattattttgttagctttacaaatcaggtgttattattttattcagaccatttttaaatttcaattggtttacatgtttgccattttatttactcacaattcgttcctcagaatggcctgagatcattttccttcttaaagttattctttagaatttccttttatacaggtctctggtggtcaatgctctagttttcaactgtgaatatctttctattttactctcatttatttaaaattcataattttaggttgatagttattttctctcacagtttgaagaaattattccacttttttgtggctttcatctttccttgttaattctgctataatgatacctgtctttcttgtgggtgatccatcctttctctccacctggtttgaaaatctctgtatttttcaatttcacaataatgtgtctcactatggatttctgtttatttatcctgcttggaatacagtgtgctttctggacctgtgaatccatatttttatcagtttggaaaaaaatcagccattatccatcaaaaaatgtcctctcctacattttttaaaaaaattatttcatcccggccgggtgcagtggctcatgccgtaatcccagcactttgggaggctgagacgggtggatcacgaggtcaggagatcgagaccatcctggctaacactgtgaaacccggtctctactaaaaatacaaaaaattagcctggcattgtggcgggcgcctgtagtcccagctactccggaggctgaggcaggagaatggcgtgaacccgggaggcggagcttgcagtgagccgagatggtgccactgcactccagccggggcaacacagcgagactccgtctcaaaaaaaaaaaaattatttcatcccgagtctctgattcaaagttaatcttctgattccatacttcatatctcttcataccttccaaattttctgcctctttgcccctctgtgatacattttggggaatttttttcaaatgtatccttcagttcatcaattttctcttcttctgtgcataatctgctatttagcctattcatttaggattttaaaagtaatctcaagtattaaatttttcatatctgaaaatgccatttatttttcaaattttcctactattatagtcaccattttttactcattttaatgataaggcatattatttatttaaatattttgtttatatatagtggttctatttcttgtttcctatttccagtaataatatctatagtcattgagcgctaaatatgtctgtgttatttttgttgatatctacttatagtggtttgcttttcaaggtatttagaaataatttattattaactttattacttgattttaatctatggaagcttgtcaatctcatcagggaaggttttctgcagagagaaaaccttgtgcttccctgagctgtgttgactcagccttccagccttccagctgagccagggaacagtgtcccaaatagcaacactattattcccatctgcactcagaacaacaacagccctcctctcttctatcagatgtttttagagagcaagagtgactggagcaggcaatgtctcaagaacatgtcttattcagaatatatttgttctgctgcagaaagatctctcagagtacctagactgacataatactttgaagcataatatttttatttaaaaatgtacatttgtgacaatttcacttcaaaaaaaccacagtttattaggaatcaaaagtttttaacgtgactctttaaatgatttgtaccctactacataggtagggttaataataaattgccttgctctgcatgtttttgtcttgtaatgtatgatgtaatatataatcaataaattatcctgagaattgtataaacgaagaacaagcttattttaattaattatggcctcaaataaagcaaatccttttaaaataagatccccctaaaaagtatatttataaagaacacaaaagaaactaagggaggtttggtattttgaaagaattccaagtagtctatgatcttcatttaaaaaaaaaagcatgcaaaataatcatagagtgtgttttgtacataaatcctggatcaacttgatttgactaaagatagcaaggagctaaactttaataatatatactgtcaacttgtctcaacaagcttttaaaggagtgctgggttttagaaatattagggagaaatattatccacttgttttttttttttttttttacttataatgtaaacttatgtgatgagctagtacattcatttttttccaaatattgagaaaatattttccagttcactttccaggtcaccttcacattgagatagaagtgtgagtcaaacaagtaacaatgagccacagaggaaactatgtagaactgacattcccttaattccccaatgtaaaaaaatcaattatagtttccaaacatacaagaaattaatttaagcaaactccaattttctggaaaggaatttatttcaaaaattacaaagaccaagattccatactaggtaaggggaaccaccaatagatattgtgtgccttctatgtccaaggtcattctatctcatttaatcctcacaaaagtctctgaagtaggtattatggcatttgcactgatgaagaattagatagctagtgaacagaggagcccgtatgagatataaatctggctaatgcaaagccggcttttttccgatacatcacgacgctttgtgtcggattaccctagaacctcctatggcatcagtacaatgcaccatccactggagtgtcctatccaagtagcactggagcttgaaaaccacccagtgggcctctttccaggtatcagtagtgatctttgggtatttattctgattgcacaattagcccaaagattgctggtatgtttagatgctgaatggtgttagatagagcatgtaataaaattccctcttctaagcaacttaagaccggcagctgcctttctgaaaagccacccaggtaagctctgttgtttcctggtctattagccctacactctgccaaactcagcatttactgcggaagccagagaatgctgacattctgacagctcttggacagcagaccatgctgtttgactctgatttcaaacatttataatcttttctcttgttccctttgctcaatacaggagagaggctatcagccaatttccccaccgtttatagcaaatcccaaggctccctcatttccagctgctaagctgcctgggcagactgtattactaaattattgtatctttttggtagagtgcctgatctgtcttggcatgcgctttgcattgaaagaagctcctgttgcaagcaaaggaagccagcgacattcacccttcccacacgtctttcctctgttaccctcaaccactaacttctttgtttcccatgtataagccaagttcacaggggcagtttctcagctatctctgcctccctagggagttaaggatttcaaagagagttctgtgctaggagtatttcccatagcctagagccagatgaataaatggcgtctagtgaataactacatcagaaccaagaggttttgtttctctcttaccaaaatgtatttctttgtaataccacagtcactgtaaccatgtattttcctcatcagaagagactgtattgggggaagagaggaaatagcctctttaactcaagtcggttgttttcaagagtgttggtcctttggtttaacttattttaataacttcccatttatatactatcccaatggattatgaatgtgaaaaaagaactattctgaagaaataaaacaaaaaaagatctacgatctttaaataaaaaagaaagtgattttgtaatataaaagggacagaaactatttttaattactctaaaatgaataaccactccgattcaattttcaaaagttataccttgaatttgaattcaaagtcacccaaatgtcctcagtaaaagctctgagaatgcagtgcattcaaatgtatcctgtgagttttctattcctgtaagcaatgaacagcctagatttttctcatacgtatctcaagagatacttcatttcaaaagagcaggagagttatcaaaagtgtaatactattaacaagatacaccatagaaaatatacagaaacgttaaagataaattatatctagggagtatgttttaaatcaactttgctgttgctatggtaagagatatccaatgtaaaacaaaaatcctctataaggctttggtgctatagccatggcaacaatgatgttcaactctgcgagtgtttccatctgattcagagagaagaaaaaaatatgctttaaatgtatgtaaaatggcttagaaaatcgatcatttatggttatctttcacatgacccttcaaccaattaaagaagacattgtaaagatagcagccagagagcctaaacaaaaggctcatagatttgcttgggtttttcatgatcacagaagctggaaagatccactttagctgaggtgttggtaaatgacatattcatttagcaactatctcacagaaattttcaggttggggcctcatgtaattttccatgcataggaaaaaactaaatgcaatcaaatgacaatttctacctctttaacacaggaagagaaatattaacctaaagtaagaaaatatggaaagtggtgttctagctctgcaaaagaaaagtctcttaaatgctagtctcttaaatctactccaaataggcttttattccacctacctccaccgaatagcccttaacaatatcagcaaaatctctaccttcctgaaatgaacattcataactctcatcttacttgacctaccagctatacaattgatacagattatcacctcttggatgaaacactttcattaactcccaaggtaccacactcttctggttttcatcctacctcctaggctgttccttctcattctctgctcattccttctgtttccaaatgtggaagcattcaagtgctccagggcttggcatactgggacctctttcctgtttacattttctgtttacattaattcctttgctggccccagggtttaacatattactgaaacaactgcaacacccaagtttctgttttcaacctgacttctcccccacactccagacttgtatatcctactgtcttagttatccttatgcctccttttctctcacaccccacagccaatcacacagcgaatcctggtggctctacctttaaaatataactgcaacctgcctatgcctcacttgtccttttctccctggattattgtagcagcctcctaaccatctcctagctttcatttttgcacctcacaggcaattctcaacatagaagtcagagttatcttagtaaaactaaggcaaatcatgtcactcctctgctcaaaactcttcaatggcaccttgatccactctgagtaaaagccaggatccttacaataacctgtgaggccatacgtgatctcagacctgtggatactctgccccaattctcttaaataacataagctcctactacactccttttcccttaactgacatccagctatattgcctcttgctgttactccaatgcattaggcattcttctgggtcatgacctttgtacttgttttttctgcctgggattttcttcccttaggaagtagcccctcctccaacaccttcttcaaatatctattcctaacgaaaccttacttcataattttttcaataaggcctccatggatcacaccattttaaatggcaaccactaattcttattcccttccctgctttatagtttctccacgacacctataaatataaaaaaatatatattttacttacttatgctatcttaggaggagagacatttttgtccctatcatttcattgctatatccagaaattagaacaaaggctggaacatagtggataatcaataaacattctttgactgatggggtgaaataaatatatagatatttgcatgtgaagaaaaattcaagagtgatatcaacatagctaaatgttaacagtgattaacaataagtgactttaaaataaaataaccttttattctgtttataaaataatatctgttcattctagttattagtaaaagtaaagagagaagaaagacactcataattccaacacctaacaaaagttactattaacatttttatattttttcttttgttttttatggacattattttcccccaatgaaaataagatcactctgtttatgtaattaaaaaaaatttaaatctcacctaaaaaattgagacatgtttattttatttgtctaaaaatttattgtctaaaaaattgagacatgtttatttgtatcatatcaatccttgaaatattcaaataactgatacatttgattttgtttctctctttttataaagtacatttggtcttttatagtgactaggggaatgtgtgtgtgtgtgtgagtttttgttagtcattacttttatgttaccgaaatcatcttcggacctgttttctctgttttcatcagtaaatttttgtttctctctttataagttaatagctaatattactgagtgcttataggtgttaagtacttcagatgcattatctgatttcattcccacacaatgttccctcacataataccccataatactctggggtattatggtattcccatttcgtaggtgaggagttgaatgcttagatgttaagtaaccaatcagggttacagggttactaagtagtggagaagcacatgaacaaggtacccatgctccttactgttaaatcatttgcagttctaaaatgagggaattagcagacttgttatctctgttcccctgactccccactcatgcccacgccccgttttccaatttatattaaaatagtctgggttgtaaagtgctgatactatattactgtatattttataccttctcttttcaatttcttttagatttatagtgttacaacaatattgagaacaattagttgaaaacattttatgtcttacaagctttattttacattctagaatcctttatgctactatttcccttgcccattcttgagaatttatttatcacttgatcaactgaagtatatctttgagcaattacttcaaagagataggttgttttctaaattactgatatggtttggctctgtgtccctacccaaatcttatctcgaattgtaatccccacttgattggatcatgggggtggtttcccccatgctgttctcatgacagtgagtgagttctcatgagatatgacggttttataagtgcttgacagttcctcctacacacacactcactctctcttgcctgccgccatgaaagacatgcttgcttccccttctgttatggtgattaagtttcctgaggcctccctagtcacgtgaaacgtgagtcaactaaacctcttttctttataagttacccagtcttgggtagtatctttatatcagtgtgagaatggactaatacaattacatatctgaaaatgacttactatggtcttgcacaccttggctgggcatacaattcttgaatctcaagttcaaatccattgccctaaaaattctatatacaattccccattgtcttctgtaagtaatctgttttattaccttaatatctatctagattcttatatgactttttccttatccttgaaattataaaaatttaaaattcccttctaaaattatttatttcagaaattttgctaaattcagtaaatctgtaatttattattctaggcattctttagctcataaacaaacaatgagagttttcttttattgatgctttacttcactgctacacttttcgttctaaaattcctatcatatgcatattggatctcatggatctttcccctgtgttttatcttttctcttgtaatttttatttatacatttcttctgtctattaaatgtcttaatattctactttactgacttgggtttctcatgatccagtgtattttttgccttctttacagttttgaatttgatatgaatattattcaaccacatgaagcgtttatgatcttacagttttaacccttcatgactgcttagtctggtttcatgcagcgttagtctactgaatatcattgagatccatttgacgttagcattttggaaaatgctcttttcttaagaaaaattttacgtcaaaggatgccactgttttcattcctcaaaacgagccttctcttttgaggtatcatttaatgtctccagctctttctctatttgctcactgttgcaaagggtggtcttagcttgtctcttttggggacctgggatgagttctgtcagggacttaggaaattctccttttcacctttaggattcaaaagagagaagaaaggaaaagcttaggttaactgccagttctgccatattgcacaactctagggtccttcattcacatagtacaaatgtgcctcctgcaattgtggctggtggtggccatgttcaccgcagttttacttcattggcctagtgtagggctgttcagtagaattttctatgatgagggaaatgttctatatctgtgctggccaatatggtaaccactaaccacacatgattactgtgcacttgacatgtagctggtccaaatcaataatttaattttaaattcatttaattttattaacttaaattttactttaaatagtcacatgtagtagtggctactgtaaaggacagtacaggtctatagcagtggttctcatagtgtggaccccagaacagcagcattagcatctcctgaacacttattagaaatgaaaattcttaggccttgctctagaatatctgggggtgggccccagaaacctatacttttacaaactgtccacttgattctcactagaaatgcatattcttaggcctcacttcagaatacctggggatgggcccagcaatctatatttttacaaactctccacttgattcttaccattaatgcacattcttaggccctgctctagaacatcttggggtgggcccagcaatctctgttttagcagatcctccatgtgattctgatgcacattaagagatgagaaccactgctctactgatcacgagttaggagaggatcagaactaacagcagtcacaaaagggacttttttctctattccagtgtttcttttctatatttgaggtgagctgctaggagttaactggggcagtgtcctcattcttcgcttctcacagttgtcctcattaagaaccaactgtgacaatgttcccctcagtgtaagtgaagagtaagcaagtcatgatccttgctttccagtgggactggcaggatccaatggtacctcctcactgcccccatgtatttctttacttcgtgctttaaccttctaaagtcttctccagttactaccatggagagttcttcacatacggggaattatatatcttcagtccagttcagtcttcaatccacttcactttgccttctatcttgcaagaactcttgaaataatcagcatgtagatgtcacccattattaacttcccatactaatacagatatttttcttccttacttttatatctgttggtcatttccaaggtaatacagaaaggagtgaactagaaaaatgctttcagtcttctgcttttccaagaaatcttccatctttctcttaatgccttaccttatatgaaatattaaaagtttttcatataattctatagtgttttatatgtatcatttcatctaattaccaaaacattccagtgacataggttttattactgtcattttccagacaaggagactgaggcttacatggtttaagtgagctatataagaggaatgggtagagcatctgctttgtaagggtctctgatatgcagaaaatgatggctaacatttattggatctttattacggaccaagcattgtgataagtgttttttatccattatcttatttaaggcttataaaaatttccattttacagataatgagcaacactagaaaggttaaataacttgtctaattacacaactggttagtaaaactgcccatttccatgccctggtttgtctgactctagaggttgtgctcttaccggctatgctgtattggtttcttggcctggaaagtaatcaaatggcatgggcagagtaaagagtataacatttcggagggtgtccttacatctcatcatttatcacacagtgggttatttaatttattttccataccactaccaagtctacagtcacgggtttaagggttaatagaaacccattaatctctggtaattttaatattttgcttattttttcttactctgaatggaatccctaaaaccatatgagtcctaacttttatctccattcattctaaatatttactgcacaactactgcatgccagacactaagcgaggtgctgtgttcttgatgtttgctaggtagctgagcaatagtccctgtcaaaacgtttggtgaattgcctggtttactgttaaactctcctcccagtctgcctttgttatgaatatgattatggattcactgaaaacttcacttgaactttaagtatcataagagtatttggaacaaataggcaccttgattgcaactccaaggagttctgtggcttccttgctgcaaatttaaaagagagaactccatctccaaatcagtgacattcagacatgtgcatcactataaaggacaagggtcaactcaccatccagactagtttgacaggaacaattcagagatgaaagagctgctttcaattgctcaagcaatgaattttccatacaatgcacctttccagagtcatgatcaaaggaatccttgctgaagcctgactcacaacacagggaaataattttatgcctaattttttttctctcctgactctctctctctctctcttgctacagatatgtcagtactaatttagttcctcttataaaatagaattaaaatatcttacatttttggagcctgttattgtttataaaatatatacatttccaaggtgtaattaaatataataggataatctgtgaggcaggtactatttcccccagtttgccaataagaaaataaagattatttggctgtacattcattcattcattcattcatttattcaatcttccaacaaacatgtatcacactgaggcactagagtgacaaaaattaatcaaacaaggtccattatcttgaacagcttatagttataaaacatacaaccagacatattataacatgtgtttttaaagaagttttgtgagcttcagaggaagacaaaataaaatctttccagaaaaagatggagccttggaggacaggtaggacttagatatgcagaaatgagtgaggtgcattccaagcacaggaagcatgcacaagcaaagatatggagctcggaaagtacagacggcacaagaaaactgagttgttttgtatgtatgattgctgaaagaagacatgaagggagaatggtgaaaaataaggttgcaaaggtaggttataatgtttgagggatataagtaatctaaccaaagtaatcagcataagtgggactcaaacccaaattttactctgcagttggagctcttaccttgctagtgctatattccaaacttcttaacacagtatatagctcaatcaacttgaaaaaatagatacaggactatcaagagaactcaactcgtttttgaaagccatctatatcattctttcatttaagaactgggagatgtatattttaaggcaactgatgcacaaactctatagacagcgatctcagtatctgtcatattaaaagtaactgtgtttttctgaacactactagaattcagagcagaaatatgagtccccttgaaaaaggggacaggaagccctaagttgttaagcagttgcttatacctggatagatcttgttcactttattgtaaatggaagtgggaatcttggttgagtgaaaatcagaccggctaagttctcagttccatcaatgtttaaggcatgcaagtggtttggctgttatgcctatgtcaccttggcctcttctatgagggccacaacacagagttcaccccttgtaatttttgtccccagtgggtattcactgcctgactcagaactttgaaaagttggagacaaaggtaatgggcataaaatgacccccaactccaacacatacacatgctggtagtgatataaagaaatgtaataggaaagcataatttccttttttattctaaattaaaaaacaatcactttcctgttttatgctatagctgacacaagtagtagaaaaatttggaagcacaaactgcaacaatatgacagtcaagggcatggactcactgatgataaaaagaaaggagggtttacatttccaaatattctccacttctgttatctttttattagggaacgccatttgagacaataagttctgtctctggaataaaatctaacatggaaagcaaaatgaaatttatactccttattaattcattgtgcataaaatcaggtgtcattggttgtattgtgtaacggcttgctgaaaatcattacaaatacacacagcacaattctagtattactttaaaatcagcttccccttgaaaacaaaatccggatattttttataaaaatacattctctaattcttatctgggaaatggctcctaaatgaacagatgatacctttgcaatttgaagttaagagctgcttatttgtcactaaggcagttagttttgactatgcagttttcgttttatatcaagcaaatacatttttttattttcctgttttaaatattattttcatggttacatttatttagagaaaattatctatggtttacacataaaagacaagcatcaattgagcaaattatggcatttataattaaatgcttcttgtatgcagtctccaacactgctaaaggaagccatcactctaacaaaatattgaatatgtttagcataaaattgcattaaacagaccctcagaattcttattaatttatttgggatgaaataagcagattttttttttttttggtcacacgttttcatgtaaattcaccaattcaaaagacttgcttattattcttatttgagacggagtctcactctgttgctcaggctggagtgcagtagcgcaatctcggctcactgcaagctccgcgtcccgggttcacgccattctcctgcctcagcctccagagtagctgggaccacaggcgcccgccaccacgcccggctaattttttgtattttttagtagagacagggtttcaccttgttagccaggatggtctcgatctcctgacctcgtgatctgcccgcctccaccttccaaagtgctgggattacaggcgtgagccactgcacccggccgacttgctcattatttttaaaagcatattttacatgagtgataccggggtacttgataactgactgagccattgttccatttgaaataaaaatatggagacatttcaggtgagaatttttggcattaaaccaaagaatgatgaatagtacatttttcaaaaaagatagcaacaatattaaaaaatttaacaaacagagtcccttgattaacagagactggagtgaaagtgaggtgagactgtgtgaaactcacaaaaggccccagttaggttgatcagtggggttccaagacataactttgaaattaggcaatccttgactcttccttctctcttacctagtcagtatctcagcccatcggattttatctccttttctaaaattgaaatgctttgctctttcttactcagacttttccttttctcattatgagagctcagctcaaatatcacctcctcagagaggcctattctgatccctaatttaaagtaatcatcctcttagccctcaccccacctactactcactgcctcctacctcctccagtcattcctatctaatgtatcatcttcctattttatttacctgaggttacttatatttgttttcttgcttattttctgtccctcccactagaatgtaagatttatggaggtaaggacattccatgttaactgttgaatccctagtgcccaaactctgtggcaagtatttgaaataacacctatccacagtgtcctaattcaggtccttataatatcctgtctgggtacctgtaagagttccctggatggtttccttaatatcagcctcatcttcctcaacccattttttgcactagagctggattgttctctgtaattcaaatctaatgatgtcactccattacacaaagctcttcattggttcttcactttccaaatgaatattgtcgaaccatacagagtggtgtgcagtatcactttaagtagttcaaaaaagaatattttaatttaatagtttttaaaatttattttaatatgcgttaaaacaaaccatcaattagcacattaacgatttcacagatcttattactgaagatgagaaaaaataaaagttataatccatttacagacatggaaaaattaatgaatgtgtctttaaaagagttttgaatgtgatcagagactaatctaaaggataaagcccaatgccttctcttcagtttcacagagtccctgcctatctctctggcataacattcactacttcttgccttgcgctttatatcttggcaaattcaaattatttgcagctccgccaattcatcacattctttatggcctctctctttttagttcagttatctcctgtgcctagaatgcctttggttggctgctttctccctgtttactgtcacatggttagctcttctcattctgtgactcagctcatgaatcaccaacttcatgaagcctttgttgtttgtttgtttctctttcctcaggtttggttaggtactacttctttgttctcccttaacattctgtaaaaacgttttgtttatacctactgcattgaaaaataactatttgtgcatatctatccttcaagtgaaatattcctaagattagggataatgttttctttacattagtatccctagcttctattataggacctattctgaataggtgctcagttaaaataattagttaagagaaggggccataacatcaataattaaaaagttaaattaaaaagttgttcacccacagtatgagacacatcatatatttattcagtcagtagtcagtcaataaactatatatatatatatatatatatatatatatttactaaatgttaaaaagtatgggcacttaaaactagtttgtcgaagagataaatgaaaaggtcttagcaacatggcatagtaggacctgttggtggggaagaaggatgaaccaagactggagtgaaggaaggattgggtaatagctggaggtaacagttgattttattgattataaatgttacatctcatcagagatggtaccacagtccatacttaccaaatcaaaggtgcatgtgggaatgagaattggtggtgctaatagaatacatgtcagtgaaactttcagatatcagatgttctgttttttgtctttcagttgggagatggaatcagtgattatcaatgttcacctgataacaccgcaaaaggggccagggcaaactgctagtaggaactgtgcagagaccctagtatgaaaaaatttattcaataaacagtgtcttctatggaccaaacactgtggatatagagatgattccagtatgatattattatggtttataatgaccataagtgattgctataaaagaagggaactgttgtcgagcttcagagctaacccagggattacatctttgttagacataatagattaaggccatgtgactagaacactcttttcagaaaactttgttagtgcttgagaaataacattaaaatccaagcaaaagacaattctgggaaaatgatgaagtaggaagcaccagaaatctatctccctgcttagacaataattgctctagcagaatctgtctactataactattttggaactctggagtataatgaagacttgaagcgtccaggagaaggataattgggatatccatcatgttaaacatttatcctgatttgaccaatacacactgtacacaggtatcaaaatattacatgtagccccaaaatatgtacagctattatatatccattaaaaatgttaaaaataaaatttgaagtaaagaattaagtaatttcctttgcttcactaattagcagaaaatttgaacataacatacattttgggagtttggattataatcatttttaaggataaaacctataaatccctttcttctctagaccatttgagagactttttataaaaagcatcatttgaagatatgcttttatttttttcttataaagcttcaataatctcttgaagttgttcatacacttctacaatgcatttgctattccactgattattgtgcagtgctattactgaccctaccaatatctctggatcatgctacatttggagaataatattctcccatatatccaacatgcagtggtgggacaggcataggataacctctacagatagttgcaatcaaaaggagggaaaatggaagttgagcaagttactggtctgtagacattctgaaatccagttgggtgcagattgcatttcttgagtagggctccatcttattggagttgttcactattgttcttagttctactttctgggtttttgtttcctccctctgaatgatcctacttttcatataagaaacattcttatgcctgctttctgttcataaaagctcaggggcccaaaggtctcttaatatattgtactttctctgtcccttctattccaagctagggatgcttccaccagaataattatctaaaaacattgtgggatttgtgtttactaattgacaattcgcacaattagataaatgtcatatccacaaatctttctgacataagtctttgtctaccttgagttccctgtaagactgttgtatgactctctacaatcctgtccaacccacggcccatgggctgcatgctttgaatgtgacccaacacaaatttgcaaacgttcttaaaacattatcagattctttttttttttttgcgattttttttttttttttttttgagacggagtcttgctctgacacccaggctggagtgcagtggcacaatctcggctcactggaacctccacccctccaggtttaagcaattctctgcctgagcctccggagtagctgggattacaggcgcgtgccaccacacccggctaattttttgtattttttgtatttttagtagagacggagtttcaccatcttggccaggctggtcttgaactcctgacctcataatccacctgcctcggcctcccaaagtgctgggattacaggtgtaagccacggcacccggccttttttgtgatttttttaaagctaatcagctattgttagtgtattttatgcatggcctgagacaattctttgtccaatgtgtcccagggaagccaaaagattggacattgctgctctgcaatgcccttagattctcagaacccttattttttagggcggaggagactcaaggcatgcccttaaggtcttaggtcttctgtcatctgaaagtttctatgagtcactatatttgatcttttgagggcttaataaggagttttgtaagcatacccagggattacaccttagactttacttccctgatagcgctctggatttgaactctgacccagagctatttattaattttagtttcatttgacatctggagagactaagaacaaaaaccactttttttttgtacaaataatcttgccccctttgtaatgaacagtctgttcttttacttatctctgttttctcacattttgtcatctaacaagaagaagacaggtggcactttcaataatctgcctggaaatcttagattgtcattagatacttttactattttccatgttattgcaaccaacagaattgccagacattctgccaccatattacaaaagtctcctttcctccagcttccaatcacattttccatactttcctttaagctcccagggacgatctacccagcgcttctgctaacacctgcctttttagtctttccccaacattcttcatgaagcactttcactaacactttttcaatgcccttttagtttctgcctgctacttggttcaaaacctacaccatatgttataggatactataatatgacatgataatagcatcatatttccaggtattaaaatttgttctagtcctctattgttacataaaatagtatcttaaaaatgcagtttcagtaagacagtggatgggactggggtcaatgcaaaggttttctcactcacatgtttggtggttaatgctggctttcaaatgagactttacttgggttgttagccagaacagtacacaggacttctccacatggctattgtgcttccttaaagcatggtggctgggttctaagagtgagatttccaaaggaccaggcaaaatctacattgcctcctatgaccctagtcttgaaggtcactttttaataattgtttttattttaaaatttttgtgggtagatagtaggtgtatgtattaatggagtaaatgaaacattgtgatacagccatataatgcataataatcccagaaggataaatggtgtatccatcatatcaagtatttatccattctttgttttataaacaatttaattctacctttttagttattttaaaatgtacgataaattaatgttgactatcgtcaccctgttgtgctatcaaatactagattctattcattgcatctaactactttttgtacctattaaccaccccctgtccccactatccttcccagcctctgataaccttcattttactctctatcttcatgagttcaattgttttgatgtttagctctacaaataagtgagaacatgcaaagtttgtctttctatgcctgtcttatttcacttaacataacatcctccagttccatctgtgttgttgcaaatgacaggatctcattcctttttatggcttaatagtactctattgtgcatatgcaccacattttgtttattcatttgtttgttgatggacacttaggttgtttccaaatcttggctattgtgaatagtgctgcaacgaacatgggagtgcatttatctcttcagtatacttcttttggggtatatacctggccacttagtgtcacttgtgccatagtcactggctataccatattcaaacataaatataaatctcacctcttgatggaaaaatgtcattatcattttgtaaggaaaatgtatagatggaaagatgttattgtggtcatccaaaatacaatctgtcacagtctgtgatagctaacctgctaaattcatcttcagtctcaattttccattaaaagaaaagaaatgattttgagtgacactagctcccagtgtcagcaatttaaaaattaaaatgaacttgatgatgcttccctgagaatgccagaagtagtaaattaagaagtaaacttttcaagagaaaaaactgtcctggatctaaaagagtaggaatacagacaacaatactccctatgccagaataatttagcatgcttactctgttagattttactgagtccttacttagcagacaaaggatgaggtttattactttttgatgaatgagagttgagttagagaagctctgggtgaatatttcatctcactagacggtttgggacattaaattttgggcattaaattatgtccccatctcctcccgaaattcaaatgctgaagctctaactcctagtagcttagtgactgtatttggatataggccctttaaagtgatgtatttggatataggccctttaaagtgatgattaaagtaaaatgatgctgttatgatgggccccaattcagtattactgatgtccttataaaaataggaaatttggacatgctgagagacacttgagatgtgtttacacagagtggagggccaccatgtgaggaggaagcaagagggtgagcatctctctcacctataaggagagagacttcaaaagaagccaaccctgctgcaaccttgattttggacttccagcctccagaactgtgagaaaatacatttctactgtttaagccacccagtctgtgatattttgttatggcagccctagtaaaagtatacaccatttttaaagtaaggataataaaaccttcttctgacgatggaatcagacatttaaaaaacatcacactgtgcctgccattttataggtagcagatgaagaaatcaccctttctgtaataagattgtgctacatatcagtcagtagagaaaggtgaaggctcaacaaatatggaggccctttaatagtcttgtaatattttacttctctggatgttacatgatctctgtatagttccttaatattttattagataaacactgtgacccctttttgaagtcacctaacttacgtctacattcccctttcttgccgaatatcactaggtcccttctcccctacctgtcatgagggcttacttcctaacctgatgatcacagagcagttcttgaaaggagtcttgagataccttcaagtacaaaagagaacttgttattttgatgtattaaaaaactgagacgtgatagtctccaggtgccatctgataagcactccccctcatccattcctatctgccatgtagttcttagtaaatgacaaagtcttattttaaaatgtgactgtgtttatttcccactgagtacccaatgaaaggaagatcacccctatttacccttaccatgaattaaaagcaaaaacaaaatcactggattcctccacaggccatgtaagaatcatgttatcaaagctactttggtgccacatcgaaaaatggcagctgagaatccaaggaaatattgattttaccagcagaaaagggtctgtgaaaattaaaaagaatattgtttattggagagaaatataaaataataaaataggaggctctaaagctatgtgtacacatgaaatgttgaagatagaaccaaagatgcacttgtgggttagtaaagagttcttccctttacttctgaggctcgcccagttctacagaagtccttgagtcctcggtactgttcagtagtttgggaagcaaaactgaaccctatgcagtcaagatctggttcaagatagtatgtgcttttgaactggtatgagtcactaactggtgctgagtcttaagggaactcagagaaaaaggtaagttcttgatcactgtaaggttgaatacacatttatggggtggaacagaccagaccattgtgaagtattgccccatagactattcctgaataggtctcatctggtagcctgaacaatagatatttgtctttcctattcaggagataatttgaacatgctttgtgatcattctcagcagattcacttgatttgtgagcaaactgatgaaagtgataatccacagacctaattctacattttaagagataaaagataaaactcttcaagcgaggatattagaaatcaagctgtctgccaaagattaatattcccttccacagaatggagccgctgtgttgctgggaagcagctgcccatcaggaattacatttctctagctcccttcatttaagtgggaccatgtgacagagagctggccaagagaatgcaggcagaagtgatgcacaccacatacaggcctggcccaggggaaactttcatgcagtcttccactgtctttcccatctgctggctagatatcaacactgaggctgacttcggaagccatgtgttgaatcctgcaaggtctctgtatgaacccctgtgtccaggtcccatcatttggactttacataagcaaggaaaatatttgctattatgataaaccactacaattttggggatgtgtctgttcccacagctgatatttatcttaactaatatggacagagacataggaaaaaagaagttccccaaatatattttgtttccatatgcttttgtgtaccctcttctgcacttcctccccctctttgattcttacacatccttcaagaccaaggtcaggcatcacctcctccaagaagactttgaaacctccccaagctgagttaaatatggatactgcatgaaggattgtaatcttctgtgtatgtgatcatgtcccaatatctaacaacctaactggtacatatttgtaaaattaatatgtaaattaataaaataaatggagaaaggtaaatacttcaagcaaaaaataaaaagtacaagtcatcctgaaaatatgaaaggaaaagtctctactggctgtggacaatgtaattgcattaaatatttaaaaatatctaggtatgactagcctttctgctgcttcatatgatcttgtattaacctaaattattgcacccaaaatgtagcatatggcacttggtacaaatctgactctttcactagattgcgaatcccctgaagacaaagactgtggttttctttgtgtttccattttcaggtcccagaatggtgcctgaaatggtgtaggccctcaccacatgcccattcactgactcgttgactcactgactggctccaggctggccttgaattcctgggctcagactatcctcctgcctttgtccttttgttctgagtcttcctcagcattttctgccaacccttcttttcaggctgacatgggttaggaggtaatctgaaagctttcaccaataagaaaaattaattgaattacatcagctctattataaggaaaagggctattgagatataatctacatactgtaaaattcatctgtttaaagtatacaattcaatgatttttagtgtacttagagaattgtacagccactcccataatctaattgtagaagatttccatcatccaaaaaagaaaccttgcagcagtcactcctcattcacactcttcccacccccagccctaggcaaccactaatccagtttctctctctatagatttgcctattctagacacttcatataaatggaagcatgcaatctgtggggtggggtggggggaggttgtagaagctttatcttttgacaaatgctgattagccttgtaaagtgcagttgaatattatcaaacatgttctcaaaatgaacaaatataggaataagatgggggtttctataactgtctaaattactgagaaataataattaggggttgggcatggtggctcatgcctgtaatcctagcactttgggaggccaaggtgggtggatcacttgaacccaggagttcaggaccagcctaggcaacatggtgaaaccccatctctaaaaaaattagctgggcatgtggtgcatgcctatagtcccagctacctgggaagatgaggtcggaggatcacctgagcctgggaggttgagggttcagtgagttgtgatcgcacaactgcactccagcctaggtgacatgagtgagaccctgtctcaaaaaaataaaaataaaataaataataattaaaggaaccagcagctcaaaatatattataaacaattctcataattgatattttatccaaatatcaaaaattcatacatttttcagatgaagggtctccagagaaacagaaccaatagagtctgtgtgtgtgtgtgtatgtgtgtgtgtgtacgtgcatgtgtgtgtgtgagagagagagagaaagagaaagagagattgttataaaattttataacaaacactaacatcgaggaatgctagtgagtagacatgcagctatatggtttggcagggcctgccagtgctcaccataaatgtcttctccttgtcttgctggatacataatctgactctcttcctcaactgtcctttataggtaggtgaccatattagttagttctggacaatggaatataagcacaatttatgtaagcacaagttatgtgttttacttctgggctgccatggtacattttatgttaacctgatggggccacagagtgctctggtttttggccaaacattattctaggtggatctgtgagggtgtttctggatgggactaacatttgaactggtagactgagtacagtagattgccctctctaatatgggtagggcaatcagttgaagactaactagaacaaaaaggccgagtgaaaaggaattcccattacctgactgcctttgggctaagatgttgttttcttttctgctttcagacttggatggcaacatcagctctcctgggtctccagcttgctgactgcagatcttaggatatgtcagcctccgtaatagcatgagccaattccttataataaatctctctctctctctctctctctctgtctgtctctctctctctctcacacacacacacatgcacgtacacacacacacgtgcgcacatacacacacacacacacactctctctctctctcgctattggttctgtttctctggagacccttgactaacacatgagcctaaaccataaccccttccacagagaatccttgctctcttctctcatctacttactgaatggatggagaggatgctatgaacctagggaaaggtggggccacaaaatggtaggcatctggggtccctgaataaagcataagaagagagctgcctagtctaccttcattgtactgcaacatgaatgagaaataaacacttattgtgctgatccactcagagtatgcggtttatgtattatggcagctagtggtatttactgtagcatttattacatgctagatttttatgaaattgaagggtaattcactcaagtcaaaatgtaactaaaaattaactgtttcagtggaatgaatacctctttgcttgtgaattttcaaaattaaaagagaaaagtctgagtcatgaactgatagtagaggggtgctttaccatgaccagtgttctggctcacatgaagccatggagtctagcccaagtagctgaattcagtggcaatgttcagatctgactcatccagtctggctcttcttaagagacaaagaacaaatactgtctgttggcgggtacttccaaaataattagcaagcaccagcatacttttattatttttttctggctatacaaacgcccataactagtatatcaaacttcatgactgtgaaaaaataaaagaacttgtgaaaagtaagaaacattttgccaggaagcaatttcattaatagagaagtagaattgtatactaggaggaacatgggctttgaaagtaggctgtcataggtttaattcattcatcactattaattaattcatcaattaaacaagtgtgtactgagaacctactaaattgaaccataaagatgctgatactcaactttatttgaactacaaaaataatggttttgtatgattcagtctaatacataacagccactgttgtatgtgctgggccttcagtaagaataaaacaaagttcctgttctcatggagattaccttttagtggtgagagatcaaaagaaaacaagtcaaatgtatagtatgtgcagtaataatacaggcaattaagaaaaatatagaaggtaaggaagatgggtgtgttgtgaggggaggaatttgctattttgtggtagtcaggaaagcatctttgataaagccatgtttgagtagagaactgtaggaagtgcagaaataagccatttggctacctgggagaagagcattctaggcagaggaaatagcaggtgcgaagtccctgatgcatgactatgcttggtatgttcaagaatagcaatgccagtgtggctggagcaaagtgggcaaaagagagagtagtaagggatgagatcagcaaggcataggactacctcatgtaaaccttgccttacttttatagggcttctggttttcactgatttaagagttgaaaaaccttggagggtttgggggagagatgtgacatgtgttttcaaaagactactctggctactcttgtgcgaatagactgtagggaagagaaggtcgaagcaggccaattaaaaggctattattcccctaatccaggcaggaaaagaccatggcttggtctaaaacattaggtatgcagctagtgagaagtggttagcttttgttctatgaacgtagaactaacaagatttactgatgtatcggatgtgccatatcaaaaaaaagaggtgctaaaaatgttctgagcaagtgaaaaggatggagttttcattaactgacatggggaaacctgaacaaggaagaggttttatggctgtgagaatttagagtttcgttttagacatttaaagggtgaaatgcctactagacattcaaatggagaggtcaaatagtcaagtaggcagctgaatacaacagctgcagagagactcaggttaggaatataaactttggagtcatcagcatgaataagacaataaactattgaggttaattgagaaaaaaagaaaagaaatagcggagacaagaactaagcctggagcattctgacgtttaggggtcaaagaaaagagaataaaaggaagcagctggggatgtcagaagagatgtttagaatgcaagtcttcattcttatgagacctctccaggtttcagtttccataagtgaaaaatacagaaaataattcctaggtcagaggatttccaaaggctgaaaagaagtaacatgggaaagcatacataagatctagaatgtgcttaataaatgttattcctgactcttggtgaaattctgggtagatgccagatttctcatgcttccttctattttttggctcctcaatcaggtcctcaaatatgaaccctatagtccaacagtgttggctatggaagtaagagcctcattattcttcagttattagttatacatttttcagtgatagagctcactgttatcagatattcatctttactgtttgttctcttcctgtgttttgtgaggagtcaggtttaaaggagagtggtcactaatgtgaagctgggaaaatggagggaggatgagttctttatcacctggcaggagtgtatccttacttcaacatttaactgctcaccaaataatttaatttcagaggatttgtttcagtgctatggaagaactatctgtatataaatagctgggttaagtagatctttcactgcagctgttaaaacctattgttgtagctagacaccttgtagtgattcaagatcatctgtctttgaagaaagtctatgctttcttttatgcacatgtagtttcttttagttctgaaaataaaataagctttacttaggaagactaaagaaaatgtttactgaataaaccaggggtagctgaaataataccctgccacaatctcctgcttttatttcatttatctgctttcaacatttaccactgaatacttattgaaagaataaaggaaaaactaaatgaatggatgaattaatatctgaatggcttttttttgcttttccttaacaagactcctcctaaataatcctaaataagttctgggttaccctgaggattatcttttacaacaagaatcatgaagtaggaatactttttcataaagaagagataaatcccagagtaacaccgaaacttacctagtaaagtagtaaacaatctgtagggaatctcaggggatcatctgatcctagtatcaggctcaagcagattctttttcaagttcttatccctcctcctcttccccaccccaacccagttggatttaaattgtgtatattagagcctctttgtaaggaagaattgggcagcagtgcagagagaaggaagagttgggtgctttaccctactgctagcacttgggtgctcaaagtagagaaacaagaaaaacaggctactggtaagatggacaataaaatgagctgcattgggtgaactgtgacctagattataacagtgctttacaaataatattccaaattataagtccctaaaattatccaaatctagattttaacaatcccgaaagccattcattttagaaagattttattttcctgtatccttccctccatttctactcctgccaccttagtccaaaccagtgttttttttcttgccaggacaatgacaaaagcttttcaaccagtctcttcattgcttctgttgctcttctgtaatccattctccatgtagcacttggaataatccgactaaaatgtaaatcaaatcaaatcatttctctacttacaatctttcaatggctccctatagtacttggaacaacgtccaagctcctccctgtggtctttaaggttttttgtgatccggcccctccctgcccctctaacatcatattgagtcattctctccttcactattctccagctacattgacatccttttacatgtatggtgcttgtgtatgtttgtacatatctatatagtgtatatacatataactattttttattaggatataattggcatacaataaactaaacacacttaaagtgtataacttaaagttttcagatttagatatatgcatgaaaatataaccacaatcaacaaaattggcatatctatcatccaaaaatttccttttacccttttgtaatttctcactcatgtccctcattatcttctcatccaccaggcaacaaacaatatgctttctgtcactataggtaagtttagcttttctagaattttatctaaatgaaattatacagtatatacttttttgtctagctgcctttactcagcatagttattttgatatttatccatgttgtttatattaatagttcattcctttttattgccaaatagtgttccattgtatggatatagcataatttatttatccattcacctactgatgaacatttggtttgctgccaggttttgtctattagaaataaagctactatggacatttgtataaaactcattctatcgccatttgttttcatttctcttcaaaaaatatctaggtataaatgaccgagtctagagaaggtgaagcaaaatgactgaatagaactttccagcaattgttgcccctgcagaataccaaattgaataaccatccacataagaaaacaccttcataagaaccaaaaaccaggtgagtgatcatagtacctggttttaacatcataccaatgaaagaagcactgaaagagtatgaaagatgttggcgccacccctccctcatcccctggcagtgactgtgtggcatggagagagaatctgtgtgcttgggggaggaagagagcagtaattgtgggactttgcactgaaattcagtgctgtgctgtcataacagggactaacacagggcagaactcagctggcacccaaagagtgagcatttagaccagccttagccagaggggaatcacctagcagtattgtcagaattctgacaagcccaaaaacaagctaaagcgctctggagttctaaataaacttgaaagatggtctaggccacaagaattgcaatttgtgggcaagttctgatgctgttctaggctcagagtcagtgaatttggggtgcatacaacctagtgagatgccaaccacaggggcaagggaatgtttgtgccacccctcagccaactccaggcagcacagcttgcagctccaggattcacaccttccttctgcttgagaagaagagaggggagaggaggacttcgtttttcaacttggataccagctaagccacagtaggacagggcaccagggagagtctgacagccctcattccaggtcctggttcctggacaaaatttctaaatatatcctgagccagaagataacctgcttccttgaagggaaggacccagtcctggcagaattcatcacctgccagctaaatagcccttgggccttgaatgaacatgagcaatacccaggcagtacttgtcataggccttgggtaagacccagggccacactggctttatgtgtgactgagtgcattcccagcagctgtggccttgaggagagaatcctgtttgaggaaaggagagggaagagtaaaggggactttgccttgtagtttgggtatcagcttagccacagtggagtagaacatcaagcagtttccaagggtccccagttccaggccttggttcttagatggcatttctggatccatcctgggccagagtgaagactactgttccgaagggagagatccaggcctggcagcattcaccacaagctgactgaagagtccttgggcctggagcaaacatcagcagtaaccaggcaatcctcactgtgagcctagaacagtggtggccacagcgagagacttcttctgcatagaggaaagagtgggaagaatgttgtcttgtggtttgggtgccagctcagccacagtagaatagagtaccaagtagattcttacgtttcctaactctagacctgggctcctaaatggcatttcttgtcccactctgggccaggggggagctcaccaccctgaagggaagggcataaacctggctacatttgctgcctgctgactgaagagcctttgagtcttgagtgagcatcggtggtagccaggcagtggacacctcaggacattgacaagacccagtgttatgctggcttcaggtctgacacagtacagtcccagtgatggtgaccataggggtgcttgtgtcaccccctctgacagctccagggagcccagcatgcagagagagactccatttgtttggaggaaagcgagagaagagaacaaatctctgcctagtaatctaaggaattcccctggatctcacctaagaccaggaaggtggtatttctacaagtctgtaagagtcccagtgttactgagcatggagtgccccctaatgcagatattgcaacagtgactaaagatttagatcataacacttgaatacttggaaagccttcccaagaaggatgggtacaaataagctcagactgcaaagactacaataaatacctaactcttcaatgcacaaaaataaatgaacacccacaagcattaagaccattcaggaaaacatgacctcacaagacaaactaaataaggcaccagtgaccaatcctgagtaagagatatgtgacctttcagagaattcaaaatacctgtttttaggaagcttaacaaaatttaagataacacagagaaggaattcagaatcttatcagataaatttttaacaaagatattgaaataatttttaaaaatcaagcagaaattctggagctgaaaaattcaattgatgtacaaagaatgcagcagcatcttgcaatagcagagttgatcaaacagaagaaagaattactgagcttgaagacaggctatttgaaaacacagagtcatagaagacaaaagaaaaaagaataagaaagaatgaagaatgcccataagatgtagaaaatagcttcaaaatagcaaatctaaaagttcttaatctttaagaggaggtaaagagagagatcagggttgaaagtttattcaaagggatagtaaaagaaaattttccaaatctaaataaagaaatcaacttacaagaacaagaaggttctataacaccaagcaaatttaacccaaagaagactactttaagtcttttaataatcaaactcccaaaggtcaagtataaagaaagaaacttaagagtagcaagagaaaagaaacacatagcatacaaaagaacttcaatatgtctggcagcagaattctcagtggaagccttccaggccaggagagagcggcatgatatatttaaaaggatgactgaaaatgcttttatcctagaataacataggtgaaaatatccttcaaacatgaaggagaaataaagatcttcccaggcaaacaaaaggtgaaagatttaaccaacatcatatctgtcctacaagaaatgctaaggagagttcttcaatctgaaagaaaataatgttaatgagcaataagaaaacatctgaacatacaaaactcactggtcataataaataaacagacaaacacgtaatattagaacactgtaactgtggtgtttaaagcacccatatcttgagtaggaagactaaaagatgaaccaatcaaaaataataatggggtgataaagttaaagtgtatagagttattagttttctctttgcttgtttgttaatttgtttttgcagtcagggttaagttgtcatcagtttaatgtaatgggttataagatgttatttgcaagcctcctgataacctcaaatcataaaaaaccctacaacaggtataaaaataacaagaaattaagatatacctcctgagaaaaccaccttcactaaatagacaaagggaggaagaaaggaagagaagaccacaaaacaaccagaaaacaaataacaaaatggtggtagtaagtccttacttatcaataccactgaatgtaaatggactgaactttccaatcaaaagacatagagtggctgaatggatgaaaaagcaagacccattgatccgctacaagaaaaacatttcacctataaaaacatttcacctataaaaactcatcgagactgaaaatgaaaagatataaaagatatttcatgcaaatgaaagccaaaaaaagggcaggagtagctgtgctcatatgagacaaaataagtttcaagataaaaactacaaaaagtgataaaagggttattatataacaataaaggtgtcaattcagtaagagaatataacaattgtaaatatatatgctcccaacactggaggatcagatatgtaaagcaaatattatcagagctaaagagagagacagatcccaatacaataacagctggaggcatcgatgcctcactttcaacattggacagatcatccagacagaaaaatcaacaaagaaatatcatagttaatctatactatagaacaaatggacatcatagatatgtacaaaacatttcatccaatggctgcagaatacacattcttctcctcagcacgtggatcattctcaagtatagatgatatgttaggtcacaaaagaagtcttaaagaattaaaaaatattgaaatcatatcaagtctcttctctgaccacaatggaatgaaactagaaatcaataacaagaagaatgttagaaactatacaaacacatggaaattaaacaatatgcttctgaatgaccagtgaattaataaagacattaaaataaaattttcaaaaattattgaaacaaatgaaaatggaaacacaacatatcaaaatctatgggttatagtaaaagcagtactagagaaaagtttctagcaataagttcctacatcaaaaaagtagaaaaactttatataaactacttaattatgcattttaaagaactagaaaagctgaaaagctagaacaaaacaaacacaaaattactagaagaaagcaataataaagattagagcagaaatataacagaaacagaaaagaataatacaaaacgtcaatgaaatgaaaagttggttttttgaaaagataaacaaaaatgaaaacttttagccagactaagaaaaaaactaaaaaggcctaaatacaatcagaggtgaaaaaggagatactacaactgatactccagaaattcaaatgatcgttagagaattctatgagcaactctatgccaataaattgaaaaatctagaagaaatggataaatgattatacacagacaacctaccaagattgaaggctgaagaaatccaaaacctgaatagactagtaacaagtaattagatcaaagccatactaaaaagtctcccagaaaaaaaaaaaaaaaaggcgtggacctgatggcttcactgctaaattctaccaaatatttgcagaagaactaataccaatcctactcaaacaattctgaaaaataaggggactacctctaaactcattctatgaagccagtattatgctgatatcataaacaaagacacatcacaaaaagaaaactacaggccattatccctgatgaacattgatgccattgatacaaaaatcctcaacaaaataagagcagtccaaattcagcaacacattaaaaaggtcattaatcatgaccaggttggatttatccctggaatgcaaggatggtttaacatacacaaatcaattaatgtgatatatcatatcaacagaataaagggaaaaaaacataaaatcacttcaatagatgctgaaaaagcatttgataaaattcaatattccttcataataaaaactctcaaaaaactggggatagaagaaacatactttaacataataaaagctatatatgacagactcacagctagtataatacttaatggggtaaaactgaaaactcttcagttttgaagatctggaacaagacaaggatgtcctctttcaccactgttattcaatataatactggaagtcctagtagagtaatcagacaacagaaagaaataaaaggcattcaaatgggaaaggaagaagtcaatttatccttgtttacagatgataaaatcttatatgtggaaaaacccaaactaattcagtaaagtggcaagatacaaaaccaacatacaataatcaatagcatttctatatgccaacagcaaacaatatgaaaaagaaatcaaatcccatttccaatagttatgaataaaataaaatacttaggaatagacttaaagaagtgaaagatatctaaaataaaaactgtaaaacactgatgcaagaacttgattgaagaggacacacaaaaaaatggaaatatattccatgttcagggattggaagaatcaatattgttacaataaaatgctcatactaaccaaagctatgtgcagattcaatgcaatccctatcaaatatcaatgacattctttgcagaaatagaaaaaaaatttcctaaaattatatggaaccacaaaagaactaggctagccaaagccatacagagcaaaacaaacaaaactggaggaatcacattaccagacttcaaattatactacagaaatattgtaacaaaaacagcatggttctagcataaaaacaggcacatagaccaatggaacagaacagagaacccagaaataaattcacacatgtacagtgaacttatttttgacaaaagtgccaagaaaacacattggggaaaggacaatctcttcaataaatggttctgggaaaactggatatccttatgcagaagaacaaaactagaacctatctctcaccttataaaaaatcacactacctgacttcaaactatactacaaggctacagtaaccaaaacagcatggtactggtaccaaaacagatatatagaccaatggaacagaacagaagcctcaaaaataacaccacacatctacagccatcttatctttgacaaacctgacaaaaacaagaaatggggaaggattccctgtttaacaaatggtgctgggaaaactggctaggcatatgtagaaagctgaaactggatcccttctttacaccttatacaaaaattaattcaagatggattaaagacttaaatgatagacctaaaaccataaaaaccctagaagaaaacctaggcaatatgattcaggacataggcatgggcaaggacttcatgactaaaataccaaaagcaatggtaacaaagccaaagtagacaaatgggatctaattaaactaaagagcttctgcacggcaaaagaaactaccatcagattggctgggcatggtggctcacgcctgtaatcccagcactttgggagggcaagatgggcagatcacgaggtcaagagaccgagactattctggctaacacagtgaaccccatctctactaaaaataaaaataaaaataaaaataaaaataaaaataaaaataaattagccaggtgtggtggtgggtgcctgtagtcccagctactcaggaggctggggcaggaatgaacctgggaggcggagctttcagtgagccaaaatcacgccactgcactccagcctgggcgacagagcaagactccatctcaaaaaaaaaaaaacgaaacaaaacaactaccatcagagtgagcaggcaacctacagaatgggagaaaattttcacaatctacccatctgacaaagggctaatatccagaatctacaaagaactccaacaaatttacaagaaaaaaaagaaactaccccatcaaaaagtgggcaaaatatgtgaacagacacttctcaaaagaaaacatctatccagccaacagacacaaggaaaaatgctcatcatcactgggtatcagagaaatgcaaatcaaaaccacaatgagataccatctcacaccagttagaatggcaatcattaaaaagtcaggaaacaacagatgctggagaggatgtggagaaataggaatgcttttacactgttggtgggagtgtaaattagttcaaccattgtggaagacagcgtggcgattcctcaaggatctagaactagaaataccatttgacccagcaatcccattactggatatatacccaaaggattacaaatcatgctactataaagacacatgcacacatatgtttactgcagtagtattcacaatagtaaagacttggaaccaaccccaatgtccatcaatgatagactggattaagaaaatatggcacatatacaccatggaatactatgcagccataaaaaagggtgagttcatgtcctttgcagggacatggatgaagctggaaactatcattctgagcaaactatcacaaggacagaaaaccaaacaccacatgttctcactcataggtgggaattgaacaacgagaacacctggacacagggtggggaacatcacacactggggcctgtcggggggtgggggctggggaagggatagcattaggagaaatacctaatataaattacaagttgatgggtgcagcaaaccagcatggcacacgtatacctatgtagcaaacctgctcgttgtgcacatgtaccctagaacttaaagcataataaaaaataaaataaaataaatcaaatcaaaatggattaaagacttaaatctaagatttcaagctatgaaactactaaaagaaaatggggaaactctccaggacattggactgggtaaaagtttcttgagtaatatcccatgtgcacaggcaagcaaagtgaaaatggacaaatgggatcacatcaagttaaaaagcttctgcaaagcaatggaaacaattaccaaagtgaagaggcatcctacagaatggaatacaatatttgcaaactattcatctgacaaggaattaataaccaaaatatataaggagctcaaacgactctataggatagaaacctaatactctgatttaaaaatgggcaaaatatctgaatagacatttatcaaaagaagacatacaaacagcaagcgagtatgtgaaaagatactcaacaacactgatcatcagagaaatgcagatcaaaactacaatgagatagcatctcaccccagtttaaatgatgtttatccaaaaatacgagtaataatgaatgccagcaaggatgtggagaaaagggaaccctcgtaaactgtttgctggaatgcaaatttgtacaggactatggagaaaaatatgtaggttactaaaaaactacaaatagaaccaccatatgttccagcaatcccagtgctagttatatacccaaatgaaatgaaataggtatataagacagatatctgcactcctacatttattgcagcactgtttacaatggccaaaatttggaagcaaccttttgtccatcaacagataaatggataaagaaaatgtggtatatacacataatgtagtactattcagccataaaaaagaatgtgatcctgtcatttgcaacaacatggatggaactggaggacatcatgttaagtgaaataagccaggtacagaaagattaacttcacatgttctcacttatttgtgggagctaaaatttagaacaattgaatccacggagacagagaatagaatgatggttaccagaggctgggaagagtagtgggggcaggaggagaaatggggatggttagcggatacaaaaatacagttataaacaataattaacatttagtaattgataacataacagggtgactacagtcaacaataaattattgcacttcttttttttttgagacaaagtttcgctcctgctgccgaggctggagtgcaatggcgcgatcttggctcaccacaatccccgccttccaggttcaagcaattctcctgcttcggtctcccaagtagctgggactacaggcatgtgccaccacgcccggctaattttgtatttttagtagagacggggtttctccttgttggtcaggctggtctcaatctcctgatttcaggtgatctgcccacctcagcttcccaaagaattattgcacattttaaaataactaaaagaatataattggaaggtttgtaacacaaagaaataataaatgcttgaggggatagatagcccatttaccctgataattacacattgtatgcctggatcaaagtatctcatctaccccataaatacatacatgcactacgtacccataaaaaaattggctgagtcatgtggtaggtagatgtttaacatttaaaaatacagccaaaccattttccaaagtgattataccattttatattcctaccagcaatgtatgagagttccagttactccacatgttcactaacacttggtatgatcagctgttaattttaaattttgtaacaggtaaatattagcccaatggctaatgataggaagtattttttttcacatgctgatttgtcatctgaatatctgcatatcttctatggataggtgtccattaaatcttttgctcatttaaaaaaattgtcatttgtttccttattactggatttgacagttcttcacattttccatattaactcctttataagatatgataattggaaacatattctcccagtcagtggtttgtcatcactgtctttgcaatgtttttcagaaagctgaagttcttaattttgattaagttcaatatatcaaatttttcttttatggattatactttcagtgtcattcttttaaagttttattttaagtccaggggtacatgttcaggtttgttatataggtatacttgcgtcatgggggtttgttgtacagattacttcacacccaggtgttaagcctggtacacattagttatttttcctgatcctcttcctcctcccaccctccaccctccaaaaggccccagtgtgtactgttcccctctatgagtcgtgtattctcataatttagctcccacttataagtgagtacatgtggtattcagttttctgttcctgtgttagtttgctaaggtgtcatttttaagaaatctttgcctaacccaaagtcacaaagtgtttctcttatgttttctgctagcaattttagagttttcggctttatatttatctttgcaaaatatttaatttttaatatggtataaggtatagatgagtgcttttatccttttttttgaaaaccatatccaatttttccagaaaatttgtggaaaagactttcctttattcattgagtcaaacctttgttaaaaatcaattaaccatataaatgtggatctgtttctggactctgtattttgtttcattgatctatttatttttacattgataccacatggtcttaaatatcatgactttatactatatcttgaagtcagttggtgtgtcttacagctttaattttcttcaaagttgtttttaaattattctgcatttccatatgaatgtgaggatcagtttgctaatttctacaaaagcctgctgggattttgattgggttggcatcttttctggtcttttaaaattaaaagcttatcatcactttaagacttttgtattttgttcattggttcatttatcttcttttctctttacagggatctttcgatggctggctcctttgtatcattcgtatttcagctcaaaagtaacatcctcagagatatctttccttgattacccaatttaaatttatatccctcatctctttatatcaaagcattgttttgttgacttaacagcattaattatcatcagaaattaatcttgcctatttgtttattttgttgcttattatctgtctagccaactagaatgtgagaaaagagtagagaccttgcttgtcttattcagtttgtatccctgaagccaaaaagtgcctttgataagcggatactaaatatttgtcgaatgattgactatttgacaaatgtgcatttaagtaaagattcaactagtatgaaaatatataatattaactagaatatgttaacttatttatgaaatgatagttctctgggaagactgtgggaacttgactgtgacttaaagctgtagttctcttgaagattatgaattgcgttgggctagattatggcatttcagaaacatagatttttggtttttaaactaaacatctcaatttagctcattagctttgttagcagaatttaaataggtctcacattagagttattcctgattactttaggaatgtgaatatctagaacaaataaaatctttccccaaacattacacagataaaaggcagaaagtttcaggtccatgagaaattataggtatttcctaaataatatttaattaaaaataaatactagtcataattttgacagacagaggcagcaattaaaacatacttcatttttgtccttgattgcttaaagtagcaaacaatgaaatcaatttcttgagccctatccatgttgcaaaggtataaataagattttatccttaatgagatcatacaacacagatacaaaacctaaggctgtttcaaaatgttttgtagtagcgtaaacatagaattttatttgctgagctatttctctcactgagaaccttcattcattgaacccaccaaacttgtgttgagcaccagctacatgttaggaactgtgctaggcaatggagataagaaatgaataaaacagagtctcaatccttcaagaagtcacagattttacaatttcaattgcttgaaggaaaagtcacaactgaagagactggaaattgtggaaatggtcagctttttttccctgattttgttctactgtggtccttacgtggccttcattcaatacctaggcttcatggtgggcttagctttccccttccaagtgactcacaggcaactccagatctagtgttctattattagccttctcaaacctgattattctaagaagcacttcccactggcaacatggtaatcatgtttaaatataactcttcatgatcaatctaaatctccagatttttaaccaagtttccctgtggcttagataccttttttttttgctttgtttttaattaatccacgtttttataatcctatgtgacattaacatgtaaggggtgtgtgtgtctgtacgtgtggccttctgcactaaggcattagacagaaacaatttgaatgaagaccactggctcttctagtcaaacttcctctttctgtatactctgcctgtatctgtcatctgtctatacctgtcagatgtctgtacatgtcaggaataaagctaacgggatgtataacaactaataattcatggtttgaataactatagtagctttcatttattgaatgtttcctacgtaccaatgatatgggctggctgtgtccccacccaaatctcacgttgaattgtaataatccccacgtgtcaagggcagggccatgtgtagataattgaatcatgggggtggtttcccccatactgttctcatagtagtgaacaagtctcatgagatctgatggttttataaatgggagttccccaacacatgtcctcttgtctgccaccatgtaagatgtatcttgcttcccctttgccttctgccatgattgtgaggcctccctagccatttggaactgtgagtccattaaacctctttcatttataaattacccagtcttgggtatgtctttattagcagtgtgagaacagactaatacaaccaggaaccaggaaatatgcatgtccttactttatttttgtatcaatcctatgaggtagggacttttattttcttcattttatcaataaagctcaggtagggtaatttggcctagattacatcagtaagtgaagagaacaaggtttcagcttaatcctgtcaatctggccatagcctatatacttaggctatacaaatattaaagtatactattaagttacaaaatattaatattaaaaactaagaatggtttctatatcctctacaacccaattttccaatctttcagtaaccagggcaatgagactgaaattgttcattttctgtttttatagacatttctgttttttaaaacaagttgttagcatcaaatttcggtctctgtgaatctggaaacacaaggctatagctgacctgtcagttattatattatttgtttttgcaattttggccacaggccatttatcctatttcatgtttgttgctttttttttttttgagatagatagggtctcactctgtcacccagactggaatgtcatggcacgatcatagctcactgcagctttgaactcctgggctctagtaatcctcccacttcagcccttcaagtagctgggattacaggtgtgcgctaccatgcctggctaagttttctattttttgtagagacgaggtctcgctatgttgtccaggctggtcttgaactcctggcctgaagcaattcttctgccttagcctccaaagcactggaattataggtgttagccactgcacccagccttgtagcttctgaagagcaggaaggagagcttgtgagttaatatgaaacattaagatgtcaatatcatgaaataaaggcatacttttcatagcaaacctttccataaattactcttacgctttttctttctttattcctcttgaactgtaataaaaatgaaaactataacaaatataatcacttttaaatgtttcttagtcctaagcttctatcctgttgctttccagtaatgtgtttgtggttgctgttgtaactataacaccttaactttcaatgatctaattttcacagtaaacagttaccctattttccaaagatcacactctgacaatagaagttaggacatatctatatgcatacccatatttgggaaatagattaatcaactaacacagttttccaaataagtaattttttaaaaatccctttttttccattttgttaagccttttgtattttctttttgatattaggtattgacatgaccctgcctgcacagttccagtgataaacacttgctttaatgatttattgcctttcctggaaaggaacaatgaatgatctgaacttattgctgttcctatgcttggtgggcaaatcacattgagtttgccttcatggtcaatacagatggctgtaatcaaatcaattttgggacaagccacattgaatgctaaaagcctgatttgaatagcacagcctaaagatgatggaacctatgccactgccagctgattactatgctttagaaaaataaaaatgttttaattaattacggggatgacaaaaatctgtattaaaaggagtaaaattggaaatctaatcaagggtattaaaatccccaacgaattaggcctgaaggaaggatatctaaaagatgtaccaatgagttcatacagacctacagatacatctaatgaatggttgctaaataggacaaatatagctcattatcattttagaaggataattatagataattacaggtaaactatcatcccaatgctacatgtgatgtagatgacatgttatgctgggctttttgttttctctcacaacacttattgaatatccactaagtttagaacatcacagaagttcagatttgtaaataagaaaaaaaaaacaacacagaaaacatagaccaaagcccattataataaactccatggagcatctacatttttgcttgcagtacaattttgtttacatatttacaaatcactttcctatcaacagggaactagagactaataaaagggctcatgcccaactgttctggagaatttaagcaagtaaaatgttgtgttcaaaatgcagtaggggtaagaggtggataaaatgcatataacttcacttttgcttattctttctatggttcagccttgatctggtttggtgcacaaatgtgaaggtttagaggcatactttggctgtgcagtttaggtagtattttgatgcacatgtaaaggctagaaaaaaatttaaaagtgctatttggtgactagatgtattcggtttcagaactaataggctatatagagatataaaagaggatatttattatgggaattggctcacatgattatggaggctgagaagtcccatgaggtgccaccagcaagctggagaaccaggaaagctggtgtgtacttcagcctgagtccgaatctctgagaaccggggagccaatggtgtaagtccgagagtccaaaggcccaagaaccaggagctctgatgtccaagggcaggagaagatggatgtcccagctcaagaagagagcaaattagcccttccttcaccttttcattctatctgggctctcaacagattaagtgatgcccatccacactggtgagggcagattgtctttactcagtgtactgattcaaatgttaatctcttccaaaaggacccacatagacatacacagaaatgtttaccagctctctgggatctcttggccctgtcgagttgacataaaattaaccattacaccagaggaaaaaagaaaaaaactttgacaaactaagttatctttttaatacatgggtagaattaccactcacacagtaaagaaacaaagagctgttgaacagatataatgtattataatgcatttagtggaccattttagaatatagaaatggagtaaagggaaaaatctgtgatcaaaagaattttaccactcattcattcattcaaaatacatttatgtattaaatgtacataatagatttactcattcactggttcattcaaaaacattcagtatatgctatgaaccaggcactgagtgagccaatagacttggtttcccaaagtcagaaaaagatgaactcttaggaaaaaatacacaaaaatgaaaaacataaccataaaatcatcaggaaatagcaaaatttataaacataattacagctattaaataatacttgtataaaaaagtacacagtgttatataaaaaaaggcataaagcaacggtaaggcattggagagattggggtcaaatgaggttagtctttgaaaaggtcaaccaggagactgcatttaaaagcgggaaaaggatataatttgttcaagtgaagtgggaatggtgtatcaggaaggccaagcaattctaggtgggagaagtgtgtacagtagaaggttttcttagcagaaacacagaaaacaggtgtgggaaatatcaccagttcttaacttggcctgtctctctattaagaagagggtcacaaagtgttcacagatggagatattctctttccaatgggataacagtactgatttagttcatatgaaaagattttttacatgaaaatcatattttttggaataaatgatgtgcaattatgtacatgacaaaagaattgatttacaggggaattttgccgcagtgttatccaaacactaaattttttccatatatttaaaacatgatgctatttactaaaacatgctttatgcactctcctcccaggaacacatgcattacacaaaagaatgtatccatttgccttaaaacaaaacaacagtagcattaccatttcattttatttagctactaatgtcaagagagctcaatgaaaggaaatgttttttcagagttgaaaaaactctgattccccttgaaaatagtcatccaaggtcaatagagatcatgttattcagatttttagacaagaaacgaatgggggattcagatgacattgtgcttcagtgatatgttaggcacatgaattattatagtggcttgaaagagaaaaattcatctaagaatcttcctaattcccctttattcactgactttctcagtatcatctatcaaatatttcaaacaaaaaggaccacattgttaagtgacataaagaataaaatttggcagcacagatttggcttttcctctcttatgcaagtataaagttatgaatacaaacaaatttagttttcacttgcttttcatcatctaatcaataaaacacattctacataatccaaagcatactgaaagtagagatgacattaaaaagctgactataaaactaaatttcaaaagagcttaaaatctagtgccatgagaagtccagaagattagttattatgttctttaggctaattgagttcaaatgttggcttttatgaaatgtgcacaagggccacctcatgattaagtaatcttagcaaacgcacacaccggtcagaatagtcacatctgaacaaaaggcacataatacttatatgtggcaatacagcaacctctaagacagccatgtgattagaaatgtacacagcagtactgctgacctaaaaaattacatttgttacatggggaaggtgtatatattattggaagtcatggacttgccttacaaatctaaatttataaacacatcatagatgaaatgcaagtttggtcagtaaattggccatctgttccagatacttacttttctgtttcaaggagaaaaacagtctattctaaatattttcttagtcaacctcccatttgaggctctagtgaccaatcaatccatcaatcatttatgtatatctatctacttaaaacaaatatttattgaggttgtactatgccccaacactgttctaaactctggggtttcagtggtgaatcagaaaaggtgcctgtacacatcctagagaggtagacaaatttaaaaaaaatcaaacaataaatatttcagtattgataaattgtataaagaaaaataaggcaaagtagaagaacacagagactattttatcttattttatttttacgtatttcaatagttttgggggaacaggtggtgtttggttacatggataagttcttcagtggtgatttctgagattttggtgcacccattacccaaggagggtacactgtactcaatgtgtagtcttttatccctcacccacctcactcttccccacaagtccccagaattcattatatcattcttatgcatttgcatcttcatagcttagctcccacatataagtgagaacatatgatgtttgattttccattcctgagttacttcatttagaataatggtctccgactccatctaggttgctgagaatgccattatttcattcctttttatggccgagcagtattccatggtattctttatccactcattggctgatgggtatttaggttggttccatatttttgtgattgcgaattgtgctgctataaacatgcatgtgcaagtgtccttttcatataatgacttctttttcactagatagatacccagtagtgggattgctggatcaaatggtcgttctacttttagttctttaaggagtctccatactgttttcggtagtggttgtactagtttacattcccaccagcagtgtagaagtgttcccttttcaccacatccatgccaacatctattattttttgattttttaaaattatgaccattcttgcaggagactgttttaaatagagggacctgggagggtcttcttaacgcggtagttcacatttgagcagaaggttctcgttctctagtctattatattttcttataatttaaaattgtgcactctttgtgcagtgctgattcttggctttcctttcccccttctaccgttttcttttactagcttttgcctctcagagagcgtgagttaggaggtgaaactcatttatttgtgacaatgttgttcctgctgacagctttacaaagagttttgattgaaaagaaggctgaaaataagggataaaatgagatattcttggattctaatgatgcacattttctctgccaccctgaactcatatatcagtaaacaattgagaattgcctagctttctgagtgatctctgtttatcataggctctgggaatatgtctgatggtgatctcttataatacattaaataatatattttagtagtccattgtaatttgttcatctctgaatttggtaggaagtcatcctgatctttagcaatgaatgtgtactttgagattcccttgaattcataaaaaaaggttaatgtatccatattagtctgttttgcattgctatgaaggaatacctgagactgggtaatttataaggaaaagaggcttattggctcatggttttgcagactatacaggaatcatggcaccagcatttgcttccagtgaggcctcaggaagcttacaatcatagcagaaggccaagggcggtggggggcaggtgtatcacatggtgtgagagggagcaagagagagagagatgggggaggtcctaaattctttttaacaatcagttctcacatgaagtcattactgtggggagggtaccaagccattcatgagggatctacccccatgaacccaacacctcccaccaggccccatctccaacattggggaacacatttcaacatgagatttggaggggtcaaacatccaaactatatcagtacctattttacaaattgtatatttctgctgatatcaatttaaataaaattacattatttcataattatctgactcatgtcaggaattatcactaaattgatgacaaaagctttggacagtagaacaatctcaaaatattgtttccctagcataatgatgctgtctagcaataggatagaggattgtgggaatattttagctctgaaaaaagtggttctttacagttacaaggacagagaaaaactcaatatttctagaaaggaatataaagattcttactctcagaatccctggaaatacaaatataacaagaaatcttgtttcatcaaaattcttgtgaagttactgcagctaaaatcaggagtcaaataggggattctctctatacatagcaatggtcaagaaagcttgaataaccacagaaaggagcctagaatcaaagaagcccagggtaggaaggcatctttaaaatcacctggttctatacttcattaaaggcttgaatcatccagcaacttctctgccatacaatattcagactccagtaatggagaacccatttctttctaaagcagtgaactcctttaatggaaacctacataaatggtaaaatgtcctcccttgttgaactgaaatctattttttctttaacttccatttccataacagaaatttaactacactttgggggatgctttttactttcataaagcattttgactatgcacaagaatttgaactccaggggttttctggacctataatttagattttgggaggatatggtgggggcaaggcaggaagaaaagaaggtcttagtgttgtgcttcaatccagaaattcctgaagttcatcaccaacagttattggaggagttgttaataaagtaatttttaaatgttcactgttattgtttcttgtgtactgctccctcagcaacctcacaaggtgcaagtggggtaggggatgactgagaaggaagcattcagccattcctgggtctctagacccgatgccatcaaatactagtaaatctctgttgtaacccctagcaaagactttactaggcaggtttttccatcactgaacaagctgaatatttagaaagtgttttcttgtgtgtctccctacccccacccccataactttcaccactgaatcctttactagataagcaacacataagggtatttggagcccttcatgtaattgaatagggggatagtttctgatgatggttttacatgacagatggtttctagattatccaggtttttatcaactggatgctgtctagcatatcaaagacattttaaaacttttaaataaatatgtgctaagcaggtccaaagaggctaccacttctggtgatctggtcactgtccttttcccaatgcagtataattttatgagcactttgttaaagctgcatctctttgcaaaccagcttggttaaatttcctatttcattttcacatatctagtgttcattttcacatatctagtgatctgttcttatacagttgatttttttaacctcaaggaaggattttatatttatccttagtaaatttcattctaatggtttttatctagtgttatagcctctggagatcatgctgcatcttgattttgtcatcagtcagttaagccattactccactcccaggtttgtagcatccacaactttggaaagtacaatgtaatggtccttgtcgtccctggctctgccttcttctaacttttgcacttaaggtcaattaaaatgcatgaattcaaaatagtttttccttccaggatcaactctgcttattagactgaaggtggggacagaatgaatttagaatcattttattttagcacaggaaaaactgtataattgtgattgttggattcttcaggattgcatgatataatatttcaaatggcctctaatttctttaagtctcttttcagggaggaaaatccaggtttatatgcaaaaatgtagccagtatgcatatctgacaaaaactcgacaagtaggaatgaaagcagtgtagaccaaggaaaatggcttgacactggaatagagaaagggtgaataatctggagtcaaacaaaggtcccaagagagtgggtgaaactctccctgaatcttgagttcaaactatatataaaggtttgcaggaaaagaaacagaaaaaggcagtgaacaggcagtcctggagagcctggacaaagaaaaagattataataagagaaagacacttccttgtcattttatgggaaaatgagaaggaagaggcaaagaagtttgtgtgtgtgcatgagagataggggagggagttgggtagtgagagttgtggtggaaaaacacctgctttgtgctttttgattctttctggagcttagctcaactgaatgtcttttttttttttctttcaagaattgacatgctgatataagagctcaaaaaccagcaatttctaatgaggtttgctacatcaaatgtgatctaggccaaccttttttatttagctgtagtggaaaaaacaattctccaaaggctaattcttgctggaggtcacacagccaatttgtttcagagttgagactagagaatccatgtctcccaatcactggttcagtagtcttttctatggaggactccctcgactaatagttcaaacaacacaacatcaaataagccttgttctctatcaacctgatctatcttctgctgatagctgattaaacaaacgattatagcaacaaatgaatgattgtgactcgtttaactatatctggacctggaggtagctatttgtttttatattaggttttaaaaaatggatttaaatattataattctatagaaattatagagaacaagaatcagagcaatcactacatagctctatgaatttgctgcagagaattaagacataacatatcagatacatttgaagcaccctatgtattactttgtaatctatttctcatacttcttctttaaatgtgttgattatcatcttccatgaattaggttggtaaagaagttgacaaggggctttatatttttaaaatagagaaaatactgcaatataatatttgattacacgaataggggctggtacacaaatgtttgtccttcaatttccatttatgaatggatttgcttctaggctgtcttttccatgtcattatcatttgtctatttctgtattaattccacatcatcttaattactaatagtttcataagatttgatagctgacaaagcaagttctcccatattttcaagctaattttggctccttgtttttcctcattaattttagaatatgcttgttaagatccaaaaaaaactttgttgaaatatgataatggttttatactgtaaattgagagatgaataacatctctatgatattaagtcaagccattttggatatggtctatggtatcatttgtttccatttttatatccttcaaaactgttctgtatttttttccacaaatgtctttcacacattttattagatttgtgcctaggtaatttatagatttattgttattatgtaggaagaatactatatttgtataatatatatagtatatatgtatactatatataacatatatgttacctgtgtactatatataacatatatataacatatacactgtatgtaatagatgtgtatactacaggtatttacaaatactatcagttttcatgtattaatcctacagctaggaacctggctaaactccctaatagtttgtagttacttttaggttttctatggttgcaaccttgtaaatcccatgtaatttcagtttatgttttccttttcaaccattatgccttgtatttctttttcttacctcattgcattggccaggttgccattatattttaaataagagcagttatgttttagatagataatttttgtcaatttaaaaatttatcttccatttattgtttgctaatttggtttatttttcaattttatgagtgtggaattttatcaaatatatcttaagctcctactgagttaatgttatgtttttttccctttaatctgttgtcattaatagttttccacatattgaaacactcttatattttcattaatttttattgccctataaaatctgatattatcagctgaaagtcatgcttgccaaggattttcaaggttaaaaatcactaagtgtgagtcttgtctttaggaatcaagtggtgcatcttaatggatgtgtatgtgcacatatgtatacacattaatttagataaacacacatacatctagtcacacataaatacataaatatacatgcatataaaataaaatataaataatggtgcttatactttgtccattttatttcaggacaatcactgaagttttcattgttgaatactaacaaccttttgtaatagccatatattacaattggtgtagcaatgagaacaaaataaagtgaagctctacagaattttaaataagcctaagcagtactacaaacagcattcattttggctaaacactatgatgtcctcttaagaacattacttaaagattttaaagctcattttctctttagtaatcacgagtttggagtgaagtggcaatgtagggaataaaaagaacttactataaatggtatttgaaaattccttatgtggatccacatagtgttgctaggaaacatggtttcttagcatttggaaagctagaaaaccaagtttcttacctcttttggccacagaaatctgtatcatggatctgatttaagagagtttggagattagttggcttcaaaatattcggataagcataaattatgttttatgaccaaccatcccttaagaaataataacatgttttcaactcatgctcaaaaataggaaaatataccctgtatcatctttcattactgggatatcacataactgaaatattagaatagtggttaaaactatagtgatgattaattttacatgtcagcttaactgggccacagggtgtcctgatatttgatcaaacatgatggatgtttatgtgagggtatttctgaatgagattaatgtttgaattggtagattacttaaagcagcctgtcctccctaatgtttgtgcctcatgtcatcagctgaagtcctgaatagaacaaaaggctgtccctctttctattagcgaggattcttcctacttgactaccttcggattgagacattagctcttttcctgctttcagactcaaactgaaacgttggctgtttctgggtcccaggcttgcttaccttaggacaggaactacatcactggctctcacggttttcaggccttcacactcaggctgggaccaaaccatcagctagctatcctgggtctccagcttgccgagtcaccctatagatcttgggagttgcctgcttccataatcatgtgagccaattccttacaataaatctatctatctgtctgtctacatcctattgtttctatttctttggagaatcctgactaatacaaatataaactctatagccagattggttaggtttgaattacagctttgtcacttactgcctatgtgactctcagcaagttatttaaaatctctgtgcctcattttcctcacctttaaaacagggaaaacaatagcacctgcctaatggaactttgtgagaattaaatgagctattacatataagacacttagtaggacgcctgaccataataaatgttggataaatgttacctattattactgtgtggttgctgttgtcattcttgtattagaaaatgtattttcaggtggaactattacaaatttcaccatttcttacactcttaagacttcttaagcaaatagaatttactcttgccaatattaatctagagatggatagcccagtgagaaatttacattctcctgctaaatgggtttcctataacattgccagaaacccagcaagttgaaaaaaatatacagaaaaagaaagaaacaaatgtagactctgtgggtgagtgggtgcatccatggaattaaagagaaagggggacagtttaaatggaacgctggatgtatgtcttaagtgcatttgtatcaaaagaagggcatatatatgaaggtataaaatgtaatttcttcagcttcataaaaaccttctgggtatgaagagagattgatgaaacaagtatcaatatagaagtaaacaccatcagaattcagaactggaagtgaagaacaattctgtatgcaaattgaaaccaccagagggaacctaggtaggtggaatataattacccaaactggaaagtgcccaggaagctggattaataatctacattttaaagaagtgccaggcatttttgaagtcaaaaatgttcagaaacttttgattatgttttataatcacaaaatattttgaaagtacattcaatgtactagttggaaccataccaaaaataagagctcagtgagaaggaaagaggaatgtggtgctttttattgttatatatatttcatctttttatagtattgaggaggcttatatttaaatagaatgacagaaatgaattattccctcttgacgggtgcaaaatcttagagcattatttttctctcaaagcaaactataggattcaattccccattacaaggaaaaatgaaaaaagtatgatagcgagttttattagagagtgtactcgaagcatttggagaaattttagaaagagattgtcacaatagcatcgaaataaatcttaggaatgatttctacagtttgtaggcagaaagctatctaggttaaacgagtcatttcttcagccattagatctgcccttctgtaatagctgcacagttttgcacaaagggctatatgttagggccagcaaccaggagtcttgattttaaaagaaatgatgtcggaagtgctggctaattaacaaaaggcattggcaacatttacggacttataagcagtgaataacattgttcttttcattttatcatatgaaagtgttcacataactattatctgctatccttgaatggtgaggtgggaacaagaagacctatacagtatctgcataggaagtggtgaaataaatgtttacttgttttaaacagtctctttttagaagatcagtgtgttctttacagttacagtgagaactgtaagtctgcttgtctgacttttcgtgaaatgctcttccaaaatgacgacatagaccaagtatatattcctaaaacctgtgccaagcagctttcctatcttgtattagcattgagttaactagcaacatcataaaatagatggaagaataaagattaacctaatgaatcaatgaataggtaaatatttttaccacagacaagtcaagggtaagggtatttatgaccctctatataagaccatctttctcatccgtgacatggaacaggcatagaatgttggctttgtgttaagagggaaatttatagcattaaatgcccacattagaaagctagaaagatctcaaatcgataccctaacatcacaattaaaagagctagagaagcaagagtaaattaatccaaaaactagcagaagacaagaaataactaagatgagagcagaactgaaggagatggaaacatgaaaaaccctccaaaaaatcaatgaatccaggagatggttttttgaaaaaattaacaaaatagatagactgctaactagactaataaggaagaaaaaagagaagaatcaaatagacacaataaaaaatgataaaggggatatcaccactgaccccacagaaatacaagctactatcagagaatgttataaacaactatatgcaaataaactagaaaatctagaagaaatgaatagattcctggacacatacatcctcccagaaaccaggatgatatcgtatccctgaatagaccaataacagtttgaaattgaggcagtaatagcctatcaactaaaaaataaaagtccaggatcagacagattcacagctgaattctaccagaagtacaaagaggagctggtaccaaaccttctgaaactattccaaacaactgaaaaggagggaatcttccctaactcattttacgaagccagcatcatcctgataccaaaaccgggcagagacacaacaacaacaaaaaacttcaggccaacatccctgatgaagatcaatgcaaaaatcctcaataaaatactggcaaaccgaatccagcagcacatcaaaaagcttagccaccacgatcaaatcagcttccttcctgggttgcaaggttggttcaacatacgcaaatcaataaatgtaatccatcacataaacagaaccaatgacaaaaaccacatgattatctcagtaggtgcagaaaaggcctttgataaaattcaacatcccttcatgttcaaaactctcaataaactaggtattgatggaacacatctcaaaataataagagctatttatgacaaacccacagccaatatcatattgaatgggcaaaagctggaagcattcccttcgaaaactggtacaagacaaggatgccctttctcaccactcctattcaacatagtattggaagttctggctagggcaatcaggcaagagaaagaaacaaagggccttcaaataggaagagaggaagtcaaattgtctctgtttgcagatgacatgactatatacttataaaatcctatcatctcacccaaaaactccttaagctgataagcaacttcagcaaagtctcaggatacaaaatcaacgtgcaaaaatcacaagcattcctatacaccaacaatagacaagcagagagccaaataatgaatgaactcccattcacaattgctacaaagaaaacaaaacacctaggaatacagctaacaagggatgtgaaggacctcttcaaggagaactacacaccactgctcaaggaaataagagaggacacaaacaaaaggaagaacattccatcctcatggataggaaaaatcaatattgtgaaaatggccatactgcccaaactaatttatagattcaatgccattcccatcaaactaacatcgacattcttcacagaattagaaaaaactactttaaatttcatatggaatcaaagaagaccccatatatccaagaaaatcctaagcaaaaagaacaaagctggagtcatcatgctacctgactttgaactatactacaaggctacagtaaccaaaagagcatggtactggtaccaaaacagacacatagaccaatggaacagaacagatacctcagtaataacaccacacatctacaaccatctgatctttgacaagcctgacaaaaaaaagcaatagggaaatgatttcctattcaataaatggtggtgggaaaactggctagccatatgcagaaaactgaaatcggaacccttccttataccttttataaaaattaactcaagatggattaaagacttaaacgtaaaccccaaaaccctaaaaaccctagaagaaaacctaggcaataccattcaggacataggcatgggcaaagatttcatgacaaaaacaccaaaagcaattgcgacaaaagcaaaaactgacaaatacgatctaattaaagagcttctgcacagcaaaagaaactaccattggctgggcgtggtggctcacacctgtaatcccagcactttaggaggctgaggcgggtggatcatgaggtcaagagatcaagaccatcctggccaacatggtgaaaccccctctctactaaaaacacaaaaattagctgggcgtggtggtgcatgcctgtagtcccagctactcaggaggctgaaacagaattgcttgaacctgggaggcagaggttgcagtgagccgagattgtgccactgcactccagcctagtgacagtgtgagacttcatctcaaaaaaaaaaaaaacaaaaaacctatcagagcaaacaggcaacttacaaaacggaaaaaattttttacaatctacctatctaacaaaggtctaatatgcaaaagttaaaggaacttaaacaaatctacaagaaaaaaacaaccccatcaaaaagtgggaaaacgattatgaacagacagtgctcaaaagaagacatttatgcagccaacaaacatatgaagaaaagctcaacatcactgatcattagagaaatgcaaatcaaaaccacaatgagataccatctcacaccaatcagaatggtaattattatttttttctataagttttattaatatttgaatataattcacataacataaaattcatccttttaaagtatgccatttggtgattttttgtatattcagaaagtcatgcaagcacaaccactatctaatttttttttattatactttaagttctagggtacatgtgcacaacgtgcaggtttgttacataggtatacatgtgccatgttggtgtgctgcactcattaactcatcatttacattaggtatatctcctaatgctatccctcccctctccccccaccccatgacaggccccggtgtgtgatgttcctcactctgtgtccaagtgttctcattgttcaactcccacctatgaatgagaacatgtggtgtttggttttctgtccttgcaatactttgctcagaatgatagtttccagcttcaaccatgtccctacaaaggacatgaactcatcattttttatggctgcacagtattccatggtgtatatgtgccacattttctttattcagtctatcattgatggacattggggttggttccaagtctttactattatgaatagtgccacaataaacatacgtgtgcatgtgtctttatagcagcatgatttataatcatttcggtatatacccagtaatgggattgctgggtcaaatggtatttctagttctagatccttgaggaattgccacactgttttccacaatgggtgaactagtttacagtcccaccaacagtgtgaaagtgttcctgtttctccacatcctctccagcacctgttgtttcctgactttttaatgatcgccattttaactggtgtgagatggtatctagttgtggttttgatttgcatttctctgatacccagtgatgataagcattttttcatgtgtctgttgggggcataaatgctttcttttgagaagtgtctgttcatatcctttgaccactttttgatggggttgtttgattttttcttgtaaatttttaagttctttgtagattctggatattagccctttgtcagatgagtaggttgtaaaaatgttctccctttttgtaggtttcctgttcactctgatggtagtttcttttgctgtgcagaagctctttagtttaattagatcccatttgtcaattttggcttttgttgccattgcttttggtgttttagtcatgaagtccttgcccatgcctatggcctgaatggtattgcctaggttttctttaagggtttttatggttttaggtctaacatttaagtctttaatctatcttgaattaatttttgtataaggtgtaaggaaggaatccagtttcagctttctacatgtggctagccagttttcccagcaccatttattaaatagggaatcctttccccatttcttgtttttgtcaggtttgtgaaagatcagatggttgtagatgtgtggtgttatttctgaggactctgctctgttccattggtctgtgtgtgttttggtaccagtaccatgctgttttggttactgtagccttgtagtataatttgaagtcaggtagcgtgatgcctccaggtttgttctttttgcttaggattgtcttggcaatgtgggctcttttttggttccatatgaactttaaagtagttttttccaattctgtgaagaaagtcattggtagcttgatgggaatggcattgaatctataaattatcctgggcagtatggccattttcacgatattgattcttcctatctgtgagcatggaatgttcttccatttgtatcctcttttatttcattgagcagtggtttgtagttctccttgaagaggtccttcatgttccttgtaagttggattcctaggtattttattctctttgaagcaattgtgaatgggagttcactcatgatttggctctctgtttgtctgtgattggtgtataggaatgctgtgatttttgcacattgattttgtatcttgggagtttgctgaagttgcttatcagcttaaggagattttgggctgagacaatggggttttctaaatatacaatcatggcatctgcaaacaggggcaatatgacttcctcttttcctaattgaataccctttatttctttctcctgcctgatttgccctggccagaacttccaacactatgttgaataggagtggtgagagagggcatctctgtcttgtgccagttttcaaagggaatgcttccaatttttgtccattcagtatgatattggctgtgggtttgtcataaatagctcttattattttgagatatgttccatcaatacctagtttattgagagtttttagcatgaagcgttgttgaattttgtcaaaggccttttctgcatctattgagataatcatgtggtttttgtctttggttctgtttatatgacggattaagtttattgatttgcatatgttgaaccagccttgcatcctagggatgaagcccacttgatcgtggtggataagatttttgatgtgctgctggatttggtttgccagtattttattgaggatttttacatcattgttcatcaggaatattggtctaaaattctcttttattgttgtgtctctgccaggctttggtatcaggatgatgctgtcctcataaaatgagttagggaggattccctctttttctattgaatggaatagtttcagaaggaatggtaccagctcctctttgtatctctggtagaattcagctgtggatctgtctagtcctggactttttttggttggtaggctattaattattgcctcaacttcaaagcctgtaattggtctattcagggattcaacttcttcctggtttagtcttgggagggtgtatgtgttcaggaatttattcatttcttctagattttctagtttatttgtgtagaggtgtttatagtgttctttgagggtagtttgtatgtatttctgtgggaccagtggtgatatcccctttatcatttttttattgtgtctatttgattcttctctcttttctccattattagtcttgctagtggtctattaattttgttgatcttttcaaaaaaccagctcctggattcattgattttttgaaggtttttttatgtctctatctccttcagttcttctctgatcttagttatttcttgccttctgctagctttttaatgtgtttgttcttgcttctctagttcttttaattgtgatgttagcgtgtcaattttagatctttcctgctttctccggtgggcatttagtgctataaatttccctctacacattgctttaaatgtgtcccagagattctggtgtgttgtgtctttgttttcattggtttcaaagaacatctttatttctgccttcatttcgttatgtacccagtagtcattcaggagcaggttgttcagtttccatgtagttgagcggttttgagtgagtttcttaatcttgagttctagtttgattgcactgtggtctgagagatggtttgttataagttctctgttcttttacacttgctgaggagtgctttacttccaactatgtggtcaattttggaataagtgtgatgtggtgctaagaagaatgtatattctcttgatttggggtggagagttctgtagatgtctgttaggtccacttggtgcagagctgagttcaattcctggatatccttgttaactttctgtcttgttgatctgtctaatgttgacagtggggggttgtctcccattattattgtgtaggagtctaagtctctttgtaggtctctaagggcttgctttatgaatctgggtactcctgtattgggtgcatatatatttaggatagttagctcttcttgttgaattgatccctttaccattatgaaatggctttctttgtctcttttgatctttgttggtttaaagtctgttttatcagagactaggactgcaacccctgcttttttgtttgtttgttttccatttgcttggtagatcttcctccatccctttattttgagcctatgtgtgtctctgcacgtgagatgggtttcctgaatacagcacactgatggttcttgagtctttatccaatttgccagtctgtgtcttttaattggagcatttagcccatttacatttaaagttaatattgttatgtgtgaatttgaccatgtcactatgatgttagctggttattttgctagttgttagtttgtttgttagttgatgcactttcttcctagcatcgatggtctttacaatttggcacatttttgcagtggctggtaccggttgttcctttccatgtttagtgcttccttcaggagctcctgtaaagcaggcctagtggtgacaaagtctctcagcatttgtttgtctgtaaaggattttatttatccttcacttatgaaggttagtttggctggatatgaaattctgggttgaaagttcttttctttaagaatgttgaatattggcccccactctcttctggcttgtagagcttctgctgagagatccactcttagtctgatcggcttccctttgtgggtaacctgccctttctctctggctgcccttaatattttttccttcatttcaattttggtgaatctgacaattatgtgtcttgaagttgctcttcttgaggaatatctttgtggcattctctgtatctcctgaatttgaatgttggcctgccttgctaggttggggaagttctcctggataatatctcgcagagtgttttccaacttggttctgttctccccgtcactttctggtacaacaatcagatgtagatttggtcttttcacatagtcccatactttttggaggctttgttcatttctttttaatctttttcctctaaacttctcttctcgcttcatttcattcatttgatcttcaatcactgataccctttcttccacttgatcgaatcggctactgaagcttgtgcatgcatcatgtagttctcgtggcatggttttcagctccatccggtcatttaaggtcttctctacactgtttatcctagttagccattcgtctaatcttttttcaaggtttttagcttctttgcaaagggtgtgaacatcttcctttagcacagagaggtttgttattactgatcatctgaagccttcttctctcaactcatcaaagtcattttccgttcagctttgttctgttgctggcaaggagctgtgttcctttggaggagaagaggtgctctgatttttagaattttcaacttttgtgctctggtttctccccatctttgtggttttatctacctttggtctttgatgatagtgatgtgcagatggggttttggtgtggatgtcctttctgtttgttagttttccttctaacagtcatgaccctggaaatgctgcaggtctgttggagtttgctggaggtccactccagaccctgtttgcctgagtatccccagcggaggctgcagaacagcaaatattgcagaacggcacatgttgctgcctgatacttcctctggaagcttcatctcagagggacacccggttgtatgaggtgtcagttggcccctactgggaggtgtctcccagttaggctactcaggggtcagggacccacttgaggaggcagtctgtcctttctccgatttcaaactctgtgctgggagaaccactactctcttcaaagctgtcagacagggaggtttaactctgcagaagtttctgctgccttttgttcagctatgccctgcccccagaggtggagtccacagaggcaggcaggccaccttgagctgcagtgggctccacccagttcaagcttcccagccactttgtttacctactcaagcctcggcaatggcggacgcccctcccccagcctcgctgccgccttgcagttcaatctcagactgctgtgctagcagtgagtgaggctccatgggcatgggaccctccgagccaagtgccggatataatctactggtgtgctgtttgctaagaccgttggaaatgcgcagtattagggtgggagtgtcctgattttccaggtaccatctgtcatggcttcccttggctaggaaagggaattccccaaccccttgcacttcctgggtaaggcgatgccccgccctgctctgtgggctgcacccactgtccgacaaaccccactgagatgaacccagtgcctcagatggaaatgcagaaatcacctgtcttctgcatcactcacactgggagctgtagactggagctcttcctattcggccatcttgggaccatccagaatggtaattattaaaaagtcaagaaagaatagatgctggtgaggctgtggagaaataggaatgcttttacactgttggtgggaatgtaaatgagttcaaccattgtggaagacagtatggtgattcctcaaagatctagaagcagaaataccatctgtcccagcaatcccattactgggcatatacccaaaggaaaataaatcattctactataaagacaaatgcacacgtatgtttattgcagcactatttacaatagctaagtcatggaaccaacccaaatgcccatcaatgttagactggataagaaaatgtggtacatatataccatggaatactatgcagccataaaaaaatgagactatgtccttagcagggacatggatgaagctggaagccatcatcctcagtaaactaacacaggaacagaaaaccaaacactgtatgttctcactcataaggggtagttgtataatgagaacacatggacacaggggggtgaacaacacacaccaatgcctgttgtggggtggggaatgaggggagtgaacttagaagatgggtcaataggtgcagcaaaccaccatgacacacgtatactcatgtaacaaacctgcacactctgtatatgtatcctggaacttaaagtaaaaaaaaaaaaaaaagaaaaagaaaaaaatctcagtacaaaagatatgtctcatacaggaacaaaaacaaaacaaaacaaaaaacaatattggctttgtatctccacctgcctgcatctacttttaccactgaatacctcgctattccatgctatgagaaccctatgattcagttatatcaaatgatttgccatgctctgaagtcacccaactttcacttttcatatttgcctttcttcagtgatatggtttggctgtgtccccatccaaatctcatcttgaattgtagctcccagaagtcctacatgtgggagagacccagtggaagataactgaatcatggaggaagttttccccgtaccgttctcacggtagtgagtaagtctcacaagatatgatggttttataaggggtttccctttttgcttggttcttattctctcttgcctgccaccatgtaacatgtgtctttcacctcctgccatgattgtgaggccccctggtcatgtggaactgtgagtccactaaacccctttttctttataaattacccagtctcgggtatgtctttatcagtagtgtgagaatgaactaatacactcagcttgagttgctcttcctttatattatcctccaaaaagtttctacttatcctgtaaggttcaactgaagggtcagcatactgatatatcctcttttaacttctggacagagttgtgtatctgttctattatgcttcatttgagccctacctatttctatcacagcaagtgtcactgaactgtgaatatccacttccattacaacggagttccttgagtgaaaaatacataatacctatgagtaattaatttctgcatggcattcatgcagccatattcattttatgtgcatcattttactatcaagagttaaaattaatggtcagtgattttcatttcttgcaattttacttccttagccagcataggttcctggcatcatttcttctcaaccccaacagaggctcaattccagtactgactggaatgcttttcatgcatgaagaatattgaaaagagctctttcttactttcatgtcttatttaaacatgttacttgctttattttttaacctttaatgactatcacttgccttatttgtcacatttggactaaataatcatttcattttgtcagccagtgttaattcttatggcttgttattgaaactaagcaaattcaatgtatagcatgagtaagatgggacagagaaaaagggaactctgaagaaagtgagctattgactgtgtccctacaaaagtagagatcaatatgtaggtaagaggtaggaaggaaggctgagaagaacagactagaaaggcagtgaagtgagactcaagcgatttaaattctcatcttgcttcactttcaacttcttgtataatattttttttcctctttgggcctcatttatctcatttgttttttgagggcgatgtacttaagtcttttgtatagcaccagtatgattttgcaatatccacacataattgtattagtatttgcttaaataaaaattaaactagtgctcttaactttatgccattcccacaataatcataagcaatgatatctatataataaaccaagttaatgagctatttatttttgtgtgtacattaattacatggacattaattttttaagtccatcctatacacctaaaataacaacagctgacatttatctaaattttgctgggtgccatgtgctgttctaagctatttatttgtatttactcatataatcttcacaacatccattttaatactaattttacaggtgggaaattgtggcacagagaagttaaggctttataaaaagccatgtagcttgtaagtggcagagtcaggactcaaactcaggcagtctgtagtcacacttgggaacaatgaactagaagacatctagggtcctttccagcatcacgaccctctgattttgcttttctctggagcacactcttctcagttcctaagagagtattttatttctacttagcttaataaggtcctttcaaatagagtctatattaggctgtatttgatttttagccttttcactgtcttttatctcctcacaattacataaaattgttcacttagccagttatgaacaatgcagaagtcaaatttcattgcagtcccagaaatcactttatctaaaagtactataaaaaacattcattcttgactatgaagaggctgtacaaagttacctcttttcaagagagtcagtctgcccttgaaacttagtaatttactaaccatcatttttttttctaaaaagaaatatcaggcacagaaatttagagttgaaaggagcttagctgttatgtggtcctaacaccaaacattgaaatatccctgcctagactccctgaatgttggtcattcaccttttggagaagaatcttcagaaagtgaaattactatgtccattattaggtgttccattcattggtaaatacacctcattccctttctgaaatcagatatgccgtatatgtacagtatgtaccacataatgatatttcagtcaatgatggactgtatacacgatggtggtcccataagactataatgaagcatatagggtcttcaaaaaattcatagaaaatgcatattatgaaaaagtatgcatgaatttccaattttttacacaaaataaactcatactgaacaggatctagttgagtctctaagaaagatgagacatcagtttgaaaagagcccctatcacagcaacatgaatcctgctaaaattgaggcaagaacaaacattgaatttacactgaagcttgggtgtgagaatggtgaaatcattgatgctttatgaagagtttatggggctaatgccccaaagaaattggcagtttacaaatggatagctcattttaaaaaggagtgagaagatattgaagatggcacctgcagtggcagaccacccacatcagtttgcaaggaagaaaattcattttttccatgctctaactgaagagggtcaacgattaacagcagaaacaacagcgaatgccatagacatctaaatttgttcaggttacacaattctgactgaaaaattaaagctgaacaaactatacacttgatggttgctaaaattgttatgcccagatcagctgcagacaaacggaaattttcaataagtcggatcaagattctgaagcatttcttcaaagaattgtaataggagatggagcatggttttatcagtacgatcctaaagacaaagcataatcaatgcaatggctactaagaggtggcagtggtccagtcaaagcaaaagtggaccagtgtattagtctgttttcatactactataaagaactgccaaagactgggtaatttataaaggaaagaggtttaactgactcacaattcagcatggctcggaggcctcaggaaatttaaaatcacagcagaaggtgaagagaaagcaaagcaccttcttcacaaggcagcatgaaggagaagtgctgagtgaagtgtgaaaagagtccattattaaaccatcaaatctcatgagaactcattcactatcacgagaacagcatgagggaaattgctcccacgattcaattacctccacctggtctcttccaagacacatggggattatggggattataattcaagatgagactggggtggggacacaaaacctaaccatatcaaccagtcaagagcaaatgtcatggcaacaggtttttgggatactcaaggcattttccttgttgactttctggagggtcaaaaaatgacattatctgcttattatgagagtgttttgagaaaggtagccaaagcattagcagaaaaatgcccagaagcttcaccagagagtactcctccaccacaacaatgcttcagctcactcctctcaccaaacaagggcaattttgtgagagtttcaatcagaaatcattaggcatccgccttaccattctaatttcactccttcttctctctgtttttgaatcttaaaaattctttaaggacacctgtttttcttcagttaataatgtaaaagagactacattaacattgttaaattcccagtacaggacttgagggatgaactaaatgtctgatattgttacgtaaaaagtgccttgaacttaatggagcttatgttgagaaagtttatatatttcttacttttatattttaattttttttttacaaactttttgaagtccccttgtttaaagaaacctgatatatggcacttgatattagcattgcagttcaagtagggaaaatagttgatatgcagtaattgtgctgagagagttttccacataaggtggatgcctaatgacaattttccacatgaaaactatatttttatgtatatttgatgcagatgaaacatatataaaatataaagttcacaaatactatatgaacatcatagagtatatgtatacaaacctagattttatatataatatataatacataatttatatattatattataataaatattatatatatttatatacaattatatataatacaatatataatatattaatgttatattataatatatcaatatatattaatataactaatataattaatatattaatatacaataatatataatatataatatataattatattatatatttattataattatataatatattatctattatataatataatttataattataataattataatttattataattatataaataattataatttattataattataacatataaaatatgtaattatatattataattacatattatatataattatatattataattacatattatatataattacatattatatataattatatattataattacatattatatataattatatattatattgtctataaattatatattatatattatattataattatatatgtaaaatatatatattatatattatatataaaatctaggtttgtatacatatactctatgatgttcatacaatgttgaaattgcttgctgatgtatttctcaggacatatccccattattaagcaacgcatgactctgtgtgttagggaggtatatgtatcccccccatatatatatgccactcattggtcttaccttgttattttcaagcaaaataaaagtcggttttctttttccaaaagttgtatatatttatataatagataatattcattttagtaaaattaatatcttttcatggaagataatttagaaaagtattaaaatgaatacaaatcatccataatcccagggatcagcactgttgctaatatttttatattttcttctcttaatgtgaacatatatgcatgtactagtattctgaatatatctatttttaaactaacgggattatttatatgatcctattttctgtgtgtggtgaggctcctcctgatactctactacatacagatgaataaatttttaataatttttggggaaaatgaagaacatcataaaggtaagggcatctacttccagacaaaatgggataactgaccaaatgtgcactccttcctaaaataaaaagtgaaaatatataaaatgataatttgcaagacactgaaaagcaggaaatgaagggccaaaatctctgagaaacagcaaacaagttgagtcctatatttgccccagtttattgccttgagagagtctctaggctgtagtgcaggagaagggtaaccaggagatgaacttgacagtctgagaagacagaggtaaacagagttgtccagatagtatctaacggggtgagcaaaacgtcgaagatccatagaggaactccctcgaatattcagtgcatgcatgtgaggaaataacccaacactgggggaaaaaacacctaaaagaattagtggcaagactgcccagtgcccacacaggaccaggaacagtgcttgctcccattagtcagattagaattaggtggagtacacagaaggttcttgcctcaacagcaggaaataattggccttagatttagtattgctgtgttctggcctaacatagttaaaaagaccccaaaagatcaaaatgtttccaagtaagtcaatttcatcccaaaaaagccctcaaaaatatttatagaaatataaaaatatatccaacatcaagcaaggtaaaatttatcatgtctggtatttgatcaaaaattacaagcatgaaaacaagtaggaaatatgacccaattaagaaatataataatcaaatttgaaccagaattgacagatgttagaattggcatatgagaacattaaaatattgaaacttacatcaaaactgtgttccatattttaaaagataagtagagatctgaaagatatataaaaagactgaaaaaacttctggagataaaaattcagtctaagatgagaaacatactggctagaataacaagtaaattcagcaatgcaaaagaaaacatactaatgaaaacttgaaaacatggcaactgaaaatatcaaaaataaaactcagaaaaaatagaatccaaagaaaaatgaacagagcctcagtgaactatggagcaacttcaagtggcctaatatatgtgtaattggagtaactgaaaaaaggtttggggtatgaggacagaaaaaaatatttgaagagataatagctgacatttttccaaatttgatggaaactattcttatttttcatttaacattatgttgtcagaattcttctttctttctgtgtatcatgtgaaaacacagttcctgaagactacaaaattccctcccatggatgttttatgatttatttagccatttgtgcctgtacattttgattatgatttttcataattataaatgatgttgtaatgaatctttatacccataaatgttgatctgcatctgatccttgagatatattccttgaaatgagtttacagggtaaggttctacatatatttttagagtcttgatatataattttaagccattttccagaaagatcatatagtacttgtacatttgtacagtatatgtagtatgcattgtatattttaccacattctggtcaacaaatgtctttattaaagaataaaaagatattactgaaaaagacaaacttagctacttttgtaggtaaaaattataagccttaaaaatctgcatttcttatattattaatagctaaaatattgttcatgttcattgcaaatgccacttcatgtccttaggccatttttctattagttttaagtgtttttcttacatcaatttctaccagctgtttatatgttaaggatattaatattttatatttgtgatgaacgtttttcaaagattagacaaaatctacatgtttacatcatatgatgtattaataatttccagagctcccaccctctttaaagtgcattcacatttatcattgttcttatgtcctaaacttgcatctatttctcccttaaactgatattttctattttggttacagagcccaaacctaagaattaagtgtacactaatttcatgtatatcagaatctgttctgcttaattcttcagttcaccttatctaagtaatttctctttcacatcataagagaattaaaagtaattaagatccaatccaagggctatggactagggtaaagcctgtggtacaacttaatggaagaaatattttcttccttaggagttctatcagttatacttgagcccattgttcttgaaagagttaatgtcttatttctaaaatatgtctattatagattcaagtaaatccagctacacttacttaatgcacatatccagtacataagagaaatggaagattcctagcctgagtgccaggaaatgcagtttagatatggccctgccatctttccagaacttgatttccttcccagctacaaaatgagatccaaaccagatgatcctcaggaaccaatccagctctgaaattcgacaactttgtgattgttctataaaacaaatattacatttccctccaaaggatcttctgggattatttgcatctgttttagaaagattggaggtgggaaggggtcaatttttaatggctgcaggtgttttacaaatgtcaaagatacattgcttgcactgatagctaggtttaaaatcttcagaaaataaatgcataattagatgtttccagcatttatatagtgaatctgttcggtctttcatgcttcaaggagctaatagaacctaatgcttcctttgaaatcagtggaagctctaaacccatctaatgtgctagcttataactaacagaaaaattgggtcaatttttatcccactgatgaaaaataaatcaaacaagtgtatcttttaaacagcatgtaaaccatttaatacttagtgtactaggttatgtgcatagttttgggaaacatgaaagtgtgtgaccaaacagacttcaaatacatcatttttatacattcgagggtggttatttaaacaatgcattgatgaatccattggatattgctaggggtgggaaaaaagctttgtaatcacttgcatccaaataatacaagtttataattttatttttataaactttatgattataatcatattcatgtatatgaccgtgcatgtgttactgttaataacaacttgtgttttaagacataaaatggttttataatatgctcatggattcctggattgaacctgacacctctgggtttacttaacgtcctaaaaaaagaaacagtactctaatatggggctagatattactgaaaaagtcaactagtagcagtaaatgtcaaaattcaccttaaaatggcatctctaattataagtcgacagtagcaaagcattggcagtttccatgatattacatgctttacaacctcctgcagctgccagccaaatctccgtttctcttctacatttgcttttccttcatgacatttaatcagtcaacaatatgaacgctggagttctcctaagccaccctacagtttaaaatcctgactacttcatgttcttctgaaagtggggcggggagagcagcaagtctttcagaatgagatctgtacttatcgatcacagcatcagcagggaaattggcctttgtaggggtgaatgtggttcgttcactgagaaaggaaaaactattttgggttaaaatgaaggcaaaacaattcaggcagctgaagaggcttctgaaaactggaaagatggaatttccagggtttgggcaatgaggcagagactaaatttatggaaagcagacaggagaacaacttcaggttagtctaaaaaaggaatctggagagagcttatgtagagaaaaatcacacagactgaatcatacgtggggaatgaatagagggaaaacctgactctgggagctgcgattatagaggaaataaaggcagtaaagattaaatatcagtccctaacactgcctcaaaaaagcctgacaatatattcacagctgggtataacctctgcaggcaccactaagtagtccttccgttctattgagttccttccacagtttgttcctcccttaaacctctcatgagaaatcctttccctcgatatgctgtatagcgtgttaaagtgtagtctgaggaccagcagcattggcatctcctaggagcttattagaagtgcagaattatggctccactcaaatctactgaaactgaacacaatttttccaagatcgtagatgattcatgcgcacattaaagtttgagaagcactgatctacaacatatacgatgtgctgtctaagacttttttactgcatatcaaaacataggcagatagattacaactgtacatcatttattcattctcttaacaaatactcactaaacacaggccctattctcaaggagttggcactttgctaccagttattgaactcccttccgttctctgcattgtgtgaggtgtcagggctagaaggataaatatggcattgtccctgcccttaattagatcatagatatgttaggaaatagttaatgcaaaaaagtgtcatggttttaatgctaaaaacgtgtacctggcactgggattacaggagaacaagtattggagacatataaggaaggtggtgatcaaggtttttagaaatggaaaagtttttatagaggtgagctgagctttcaaaaaaaaaaaagctttttttcttttttccaggtggaccatggggcattgtgggcaggatgaaggaagggttagaaagaagggtgtacaagggagaggaaacaatcttaacaaaggctcaagggcaagaaacaggttggcctattcagagaactttaagtaattccatatggctggatgataggttttgaggagggtggattggggtctggtggtcagagataaggctggagagcttgacaggggccagatttagggggctgtattgtagcctaagcactttgggattgatcctacagagcagcaataagaagtcactgaaggttttccagtaaggcaataacaagatcacgtttgtgttttagaaacatcactctggaggatgtttggggaatggtgattagccaatttggctgaagcacaaagtacacagagaaaagtaaaggcagataaggctggaaatgtaaatttggatccagatcatagaggatactgactgccatgctttgtactttgtaggcagtggggagacactgaaattttctgagcaagagaatgctttagactgggaagagactaaagacagaaggccagttagaaagttattgcaataatttaggcaagaggtaataagaacctgatgactctgagaatagaaattaacagatagattcaagaagcaggtgcacaattataagcacagtttcattactcattttaggataccacaatttcatacataaatcagatctttataaatgtcttcattttcacatcctaatatagcatttacttctgtaccaatcactgggtgagatactcttaacgttctttgggtcaccaaggaaaaaatctccttcctgttgatttagtttgcaggtccctgtctcagttccatgtggaagccgctgcatgcctctaagtcacccaaacccaaaataaaaattttgttacagaattgttctctatttgcctctttggttgtttctcaaccctgaatatgttcctaggaaggcttcttggttattctttattcactttcaagaaaatagccttcccttttcccatctccagccccttttctagtcccacatttttttcacttagaagcactgattccactaggtggtaggtagggagatcaaagtcacatttccagttctcagtttttttttttttttttttttaacaatgtgagtaagttgtagggtaggtacatgttgatcgcatttcatatacctcaactgctgccagattggttttttgtatgatttatggttatggagctttatggctggtgtgaggttattttgaatttatttagaaagctctttcaagtgtttcagtttcacatcatagaatatttataattctgggtcaggcatcatgtttagcttgacttccaagatacagaattccaaacagccatttgctcctctaaatagatagatagatagatagatagacagacagacagacagacagacagacagatagatagatacatagatacatagatacatagatacatagaaagatagaagcacagtatatctgtttcctgtacatcaattttcctggtactggatggcttcattctttctaattcaagacccaccaggcctcgagaatgattagaaacattcatgctttaatattaatacttacaaaatctccctgttcttatctgagctttgcatttttgttaagatgcttagccagaatggaagctgcccacacaatgcttgtataaaaattatacttgctcaataatattcatatctccacccactcttgagtggaacagaacaagcattatgatatgcatgtacacatttgcataaaaatataccatacacaaattcaagtttgcatgcccagttccaaatgcacaccaccatagaaatgcacatttgaaaaagcatgcaatctcaatgtccagacgttttcctccctagagagtgatttttttcctaaaatgaaagaataataatagccttaatttatgtagtacatttttttccattctcctccctttacaagagatgagtcaattattttatgagcaacttaaaaaagcataaattttttcttcctttacgtatggagtaaggcaaggtgtcccaggagactagttcctcatgcaaattcaagggtgaagtgaaatttgtcaatatattcttccttttatgacagtctttccttctcttacagctacctcaattctttgccagccagctgagagatctctattgaagaaatctcttggctaatctcccagtttcccatctcttactacaaaaggtttcaattcacaaaacacaggctgacacaatcctattgagtcctcgcgatggtcttgcaattttgtaaactcatagagcagatgttatatttatttaacaaacatattttccacttctaagagttctttcttttttctatttacgtgttgtatttttatttcttcctagttttcttcttcagttttaattttttaagcttttaaaatttttttcatttttaattttcatgggtacatagtagatgtatatatttatggggtacataagatattttgatacaggcatataatgtgtaataatcacatcacagtaaatgaggtatccctaatctcaagcatttattatttctttgtattatgaacattccaattatattgttttagttacttttaagtatacaataaattactgttgactatagtcaccctgttttgctatcaaatactagatcctattcattctattttttttaacccattagccatccctgctcccacctggttcccagctacccttcccagcctctagtaaccaccattttattatctccatgagttcaattgttttaatttttagctcccataaataaatgagaacatgcaaggttaatctttctgtgcctggcttatttctattaacataatgtcctccagtcccatccatattgttgcaaatgacaggatcttattatttttatggctgaatagtactccattgtgtataagtgccacattttctgtggtacattttcatttccatttgtctgctgatggatgtttaggttgcttccaaactttcgctattgtgaatagtgctgcaataaacatgggagtgtgtagctatctcttcaatatactaatttcctttccttggggaatatacttagcaatgggatttctggatcatatgatagttctagttttaattttttgaagaacctccatactgttctccatagtggctccaccaacttacattcccacgaacagtgtacaagagttccgttttctccacatcctcgctagcattcactattattgcctgtcttttggataaaagccattttaattggggtgagatgatttctcattgtggttttgattagcatatctctgataaccaataacgttgagagcaccttttcttatacctctctgccatttatacgtcttctattgagagatgtctattcacatcttttgcccattttttaattggactactagatgtttttttcctgtagagttgtttgagttccttatatattctggttattaatcccttgtcagataagtagtttgcaaatattttctcctattctgtgggttgtctcttcactttgttatttcctttgctatgcagaagctcttcaattggatgtaatcccatttatccctttttacttggcttgctggtgcttgtggggtatttttcaacaaatctctgcccagttgaatgtcctggagtgttttttcaatattttcttgtagtagtttcatgtttgagacattagatgtatgtctttaatccactttgatttgatttttgtatacaatgaaaaataggggtctagtttcattcttctcgtatggatatctagttttgccaccatcatttattgaagaggctgtgttttcccaaatctacgttcttagcacctttgttgaaaataagttcactttagatgtacggatttatttctgggttctctattctgttccatgtgttggtttttatgccagggaaaatattcttcatacatgaaggagaacttggatatactattcaagggtaaaagattttttccttcagcactttaaatatgtcatgctactctgtcctggcctataagggtctccactgagaagtctgctgccaggcatattgaaactccattgaatgttatttgtttcttttctcttgctgctttcaggatcctttctttacatttggcctttgggagtttggttattaagtgtcttgaggtagacttatttgaattgaatctgcttggtattctatcacttttttgtaattgaatactgatctctttatctaggtttggaaagttctcttttattatacctttgaataaacttcctatttcaatctctcttcatcctcttgaagaccaataaccattagatttcccttttgaggctatttgctaaattttgtaggtgtgcttcattgttttttcttttgtttctctgattgtacattttcaaatagactgtcttcaagctcggttattctttcttctgcttgatcaattctgctgttgagagaatctaatgcattctttggtatgtcaactgaatttttctgctccagaatttttgcttgatttttaaaaattatttgtctttttgttaaatttatctgatagaattctgaataccttctctgtattatcttgaatttcaaagagtttcctcaaaacagctatttggaattctctgtctgaaaggttacatatctgtctctccaggatgctcactggtatcttatttagttcatttggtcaggtaacattttcctggatagtcttgatgcttgtggatacccatccgtgtccaggaatttaagttaggtatttattgtagttttctcagtctagacttgtttgtacccattcttcttgggagggatttccaagtattcaatggaaattgagtaatgtaatttaagactttggttactgcagccatatctgcattagggggcaccccaagcccaggaacactgagacttttagagacttacagaggtccagccttggtggacctgagagagaattgggtgagatctgagagaattccatggattatcaggcatagaattttgttgtcttcttttactttccactaacaaacatagtctttcactctgtgctgagctgcctggagatagggaagcactccctggagggcacaaacactcctgtggccacctccactgaaattgcactgggtcagatctgaagccagcacagcactggatcttgcccaaggcctgtggtgaccactgcctgactactgatgatgttcactcaaggcccaagtgttcttaagtcagaaggcggtgaatccagacaggcttgtgtacttcccttcagggaggtaagctcccacttgtcccaggatgggtccagaaatgctgtccgggaaccacagcctggagtcagaatccttaggaatccgcttggtactattctactgcagctgaactggcatgcaagccacaagacaaagtccttcccattcttttctctcctttcctcaagcagtagtctcccctgtgggtaccactgccccaggcccatgttgtgtactgtgtggctattgccgatattcactcagggcccaaaggctcttcagttagcttgtggtgaatgctgccaggcctgagtctctcctttcagggcagtgggctcccctctggcccagggaaggtccagaaatgtcatctaagagctacggcctggaatctgggactttaagagcctgctttgtgctctactccactgtgaccaagctggtgcccaagctgcacaacaaaatctcctttattcttccctctcctttcttaagcaggagtctctcctcgtggccagctctgctcagaatatgctgggccatgccagaagccagcatgtctctgagtctcacaaggcacgtggcaagtactgcctggttaccactgatgtttattcaaggcccatgggctctttagccagcaggtgatgaatcttgcctggatgatgtccttcccttcaagatagtgggttcccttctggtgcagggtatatctagaaagacagggaagatagtgcctggactgggagcctcaggagttaggcaaactgcctaagaccttatttgactgtggctgagctgttatttccgagttgaaagatgaagtcccctttactctcccatctcgtctcctaaagtgaaaggaaggagtctctctcagaactgtgggcttcactgccttgggctgggtgaggagtggtgcaagcagttccttggctggtgtcccactaggtcatgtacaccccaagtccaatggcttggaaccaagcaaagggctaagatttgcccaggaattacagtccttgtggcatagaccatctttcaagtttatttaggacccaagggcactttagcccacagtggtggggctagccagaacttgggttccacaagctggaacggataattcccctctgactagggatgctctaagtgctccctcataggctcttgctgacttctcccctgtgttgctttccactatgatggggcagcacttagttgcaatgcaaagtccagcaatcactgcattcttcctctcccaaacacacaaattctctctccatgccacactgcattgtcagggaatggggcagggttggtgtaggcaattcacagctgtctttcctaccttctctttcctagatatgatgttaaaaccaggtactgtgattgctcacctaaattttggttgttataaaggtggtttcttgtgtggacagttgttcaatatggtgttcctgaggtgggggagtacaatcgctggagggttctattcatccaccttgttccacttctctccctatttcttcaagcttttagaaagtatctgttaggatgtattaatttcataaattagcttttgaaagttgattttgttagatgcattactcagttttagatttccttatgtatttttgaattctggttttcaggcgcccatcctccctacttctgccttgcccctgaccttggcttttgacagtaatcctagatccagtctccactttcgcacaaaacttttagtcctctaccaaacagaaactgagactctgcgtcagaccatagtagttcctaggtctcaatcctgtatacttcttaggtttctattccatttgagggtcactgaaatgttctatcttgcttttgaacttggccctgtcttttagattttttagtcttaatttctttcccattgttatgtattataaacttatggggtcatattgacaggaagtttgtggcatcctcattttatttatttatttttaattttatttttgtatttcctcagagacctttgttctgaacctcattttacagatagaaatgaactgaaaaaggttcattagcctgctccaagttgcaaacctaatcaatggtacagtctgggctaccatttaagtctttcacttggctctgatgatcaaaatttatttcattttacagagagctgctctcagtgaactgctgatcagctgtgataaagcaaaaaaagtaaataacttagagtcagagaacctgaactcaagttctcactctgccaattactagtttctcttggcctcagtttgcaatattgtataacagcaatacagtcatgtatcacctaacaacagagatatgttctgagaaatgcatcattaggcaattccatcactatgcaaaacaaacatcaaagagtgtacttacacaaacctagatggtatatattttttatttatatatatgtatatatattttcttatggaaaaccaaatgccccagtaccattagtaatatcaatcatttcccctacttgatctgcaatgccaatatccagtaccagatatcaggtttctagatatgctctattttaacattatgacccaaacattgctatgtgacaaatgactatattaccaattaccttacacagtggtcataaaattaatacatgtgagaacttttaaaaaaaatgcaaagcactatgtaaatgtgaaagtttaaacagctaaaagatttgtcttttcaaagatatataaataatatgtgtttacttctgagaaataataaaatacagataagcataaaggaaagaaattgtttgcaatgtaatttagcagtgtattcttctagatttatctcaatatatatatttaaattagcaacttaatcgagcgcacttgtcaaaattttatctatatccatctatacagtaataaatcatgaaactgtctcctcaagaagttttggggaagggttttgacacaaaatcaggtaaagtaacattaggttatttgccaaatatagcattaattgtcttaccttgatttgtcacagtctttgtgttcaggtctcaaggacaaagcttccatttagatgaagcctttcaacaaactatttgtggattactcttctatacttcatggttgcaagctagagaatcctctttagctatttggagcagaagtgaatcattctaggtattaattagctcatggaatcttttggagtgctagagaatcaagctcagatgtttcacaaccagaaacaaggcatccagcgttaaagccaacagatgaaatatccacgcacactacccgactattctagaagaactgcacattgatttcacacatgagtaccagtacctacacctagatttaagagatttcactaaaactgtccctaaagaaccagacatctctatcaccatgcttgccacatgtggctactgccttctctgttcccttctgcatctaaatttgctcagtagaaccaaattcccaatagaaatgtagcttcaaggaaatctagaaataaagttctgttttgttctgttttaatttttcagctctatggtaggaaggtgagatataatggatacagaatgggtaatcagtaagccagtctgcagtatctggtaagtactgtaagtaggtagaggtaggcactgtaatttcccccattttacagataaggaaattgagccttagaaagattatgttatttggtcaataataaaggtatatagaaggaagcaaggatttcaacccaggtattctgatcaacattcaccttttaactactacaatatttaataattacttcattacatgacttctccttagaagaatatgagtgactgaagaacaataattctttctaattcagtaagtatttttcagtatcaaattctgggggctgcattcattcaaaacttcatttagtcattcaagacttttaattaaatacctactatgtgccagtactcttctagagacctaggaatatggtggtgaataaaacgcgcatagttcctgatatcatggaggtcagcatttagtgttagagttatcaggtgaaaaagtatgcattaattaaacgcgactaaaaagatatatgaaaataagagagcatttaaatgggagatttaagctagcaggtgcaggcaaagaaagatttcctagggaagctgtttgagttatagagacctgtaagatgagtaagtatcagctagcctaagggacaggttctgggaagacagtattgtaggcacatggaataaatagagtatgagatgtcctggaggttgaaaggaggtcaggggattgaaagaagtcaagtgtggctaatcatagacagtaagtaaaaactgaccctgcgataagtctaaagaggtagaaacccaaccaatgttcattgaatgaataaaggtgtgcaatctctagtagatggtagctgtgatgccttctaaacttcctgcttccactgagattccatgattccaaaagaggcagtatatctttgtatatttagaaaagaaaaggcgaggccagagtggtaaactctcctaaaattatcaaaacatattgatagtctacattaacactttagaatgaatcacttttgtggatgctatggattctgcaaggagaaaattagaatggacccatttgtctaacacctaaaagtaaaatgggaaagactaacagaataatttagaataattaaaattaagtagattagttttttctcttcttctttatttgacctttgagataatgttttgtctttatgaataaagaaaaatctttagaaatttgcctaaagctccttctcaaaacaataagtgtacagaatgcttacatcaagaatactataatttatttttaatatatttttaatcaaatagaaaaaatcaaactgccctatttctgtcaaaagaaaaatgtgaatatattccatctatattcagtaggcagaatcctcaaaataactaataccaaatacaagttttcaaatctttcaaagatttacattatgtattccaaagtaacagctaaaatcatatattaacttacacatatatcttttaagtctaccaataaaatgtgtgaccattgaaacacatttagtgatgagcaggagccacattcaatgaagaaaattaagtagcagtccagcctctctagactacatgagaatagatccaatatcccatgattcacaattgtttttaaatacatggtttatttctctattatttgaagtttgtttttttacacatatatctgaacttcaaacactgtctgacattcctgaaatagctttaatattacttttctttatctcattgccttctctcccaggtcaatggacaaagcttaaggcttccagcataaggctaatccctttatctgtcctctgaatctcattgtcagctgctttttcagggaccttacttaattattgctctcctctcagcatctacaaccttttcctctcaactaaatctttactctcaccatataaccatgctaaaatctctgtgctggcaaaaacaatcaaagacaaataataaaataacccctcaagtattctctcctcatctgcaattcttgtcttctcttttatttacatccaatatttttgaagagtcattggtacctaccagcaattctttctcacctctcactcacctccactgcaaactggcttttacccttatgctccaatgaaattactcctgaaactgtcacagtgaccttttagttgctacatgcagcgggcacttttcaagttgggttgatccctcaggagcatttgatactattaaccagaaatttcctggagcatatagaactgtaaggaacaataagccatgttcccagaatcaccacatggaagggcacccaattaacactcaaataaactattctttgtgcactaaataaacctgcattgtgttagaccaatgggatttataaaactgttccagcacatagcattacttaccttgacaaacacatgagtcttattaggtcattcttaatctgtctccctgattacccaccattcccctgctgtgaactctatgccctagctacacaaaccactgtgtgtgtatatgcatgtgtgtgtgtttgtccatgctattctattcttaattcctttcttcctattatttgttgacacattcttttagtctcacttacagcctttgagaaagcttccctgtttctgacaagcatatttactccatttcacctcatatatctctctttgtagcactcatgctattgtatcataattgttttctgtctcttaagaatggattcttaggtttttggaatatgtaaattacaggaattctaggcatgctttatcaaaacaaggttgaaatgataaacactgggcccttacataaaattttgtaagaacatcaggttctgacaaagaagaacgaatttgtggttttatattttgtttccctttagttaaaccctagatatcaaagatttataatttcttaaaaataaaatcttgcctacttttgggcaacaaatacatgaaccaaatatcctttgtatctaatttccttagaggtgattttctatgcataacagaattatcttttgcaaattatatttgcatatgatcagtcacattttttgtatttcaaatgtattaatatttcaattagctaaaagcaataagaaaaagatttatctagtctgctgtggaagtgctaatataattttaaaaaacaactaagagcactaattttgttgtcaatttcatatccttataattacctcttaaataggctgcacttctctcatggtaatcactgctgttttcaaatggcttgcaaagaagaaaagcatttaagctaactcctagaacagatgaaactatttattttgacatttgtcggctttggaccatgtcctttccaattctgaaaaagacaacctgggaacttacgtgtttagaacaaataattttaataactttggaggtgatttaaaatggagccaattttaggtgtcagataaaatgatcctaattcatcttatatcaaagatactgggcagtgacattggttggggtgtggtcaaattgttactatgccaatcactcagtaaaggagtctgaatcgtcagtggacaagatctagagatctgagaaataactcctttctttgcagccctctctatgatagacactcaagaatgagagaaaatgtagggtcattcttttaggcatggtcatatcaattcaaaggaagacaaaatagtttaggaagtggattctaatgcaagagatagtttagaggaagaatggaaagtgacgttagtatagtttatgaggtagtggtttcagttgttaaatacagataaagagaacagaagaatataaatattctaaactgtatcagaaagaatcatggaactttaaaagcataaaggactttagagagacatcattttcgttcagtcctttcattttaaagaggaggaaactgacctttaaaaaggttaaatcacttgacccaggttgcacagagagttagtgaaaatagtgtctgtgggttcctatggtggggatagggaagaacatgtaagggaagaaaggaagtgggtctcttttcattctgatccagaaacgcaaatcctttaaaaggtaggcagacctttttaaaaaaacagctggcatcacctgcggagctgagccaaatgctgtggttggtacccagcctgagcctaaaaaaaatgctctttgtaaaatttctctttgtgcacggataaccttcacaaaattagttcatgcttgcttttaaattactttgcacctgtcctaatcatacctgaaggtggcaatgtcctaagagttacatagggtttgtaaaattgggctactggcattatttttaggagcactctgccttacttaatttggagaacattttttttcctactaatttcgatgccacatgctttataactcaactttaattttcctccaaagatatccaatttattatccttgtctttagtgtatatttgcttcaagagacagtctccacaatgctgattgggatatcatatgaattccataaattcattttgaagtccttggttttagcttataggatttctacattttgactcacttttcttatgtattttcttgatagttacccccctgcctaaacaatttaactcttccttttctttttttaacttagccacctccctaaatgcatgtatacattctctctctctttctctctcacacacgcacacacacacacacactctctctctctctcctccccttccccaccaccacacacataaaatcataaaagctgttttcccaaatggagaggtatgaagcatgtgagaggtctggagaagaccaggagtcataaatgtgcacaagccaacttaaaatatgttatgaaggcatcagcgagaatgtcagagtaggagactccaatagccttactctccactgaaaagcaaaaaacaaaacgaaacaaacaaacaaacaattctggcaaaactgtcagaaacaaagttactgaaattctggaaaatgggatgtctgtgaaattctgggatgttattagatcatggggcagatttcccctttggtattgttttcgtgagttatcaaagatctggttgtttaaaatgtgtagcacctcccccttctctctcttcctcctgctctggccctgtaagacgtgcctgcttccccttcacctactgccagtcaaaggtttgcagcaaccaagagaattcttaatcaagagaaagggccactgtaacccagtggaagaggtttatagtattttaatttatttgtgtccatccccaccattgctggcttaatggtggtcctgaagaaagcaccttgttctaccagtgtgggtcctggtaccagagggagcagaacagattttgttctgaaaaaactgtggttgcctgttttgacctatcaggtggtttcctgaaggactaacacaggggacttgcctttattttgcctaactcagaactctcccagggcacaaacatggctgcacagacagcatctatataaatacttaatagcaaatcaaccagccactgctacgcccatgagacaaagaatattagatgggataaacaataaacaaaacaaaaaacttgagaagaaggctgggaagtgagatgcttgggggagtaagggctttgagaagcttccacatattcccaggtatctagaaggtcacacacatgcgcagaacaggccacatgatcaaatgatcttgagaagatcctaaagtctcacctttgggtgaacttcagactctgtgaaagcaggaaatgaagttgaaggcagagttgtaaactgcttagctgagtgttaaaggcctgccccaacatacacacagagcccagttgcaaagactgagagagtttttgttttatccaggcatttaaggaaatctttgtcaaatcactagctgaccattgagttagtagaacagagatttcagtgaccacagaggataaaaaatactgtcagtaaaaaattagaaaagtcactaaacatacaagtacaacccaagacaagtagcaataacaaaaacttggggacaagaagaatcggatttccagttactataatatttaaaatgctcagttttaaacaaaaagatattagacttccaaaaaaaataataaagtgtggcccatttacagggaaaaaaagaaatgaatgtgaactgtccctgaggaatcctagacactagatttactagacaaagagattaaatcaactgtcttaaatatgtttaaagccatagacaaagaaccaaaggaatatatgaaaccaatgtctcaccaaataaagaaggcagaaatgatataaaggaaacaaattctggagctgaaatgtacaagtataatactgaaataaaaaaatctctagaaggtttctacagcacttttgagcaggtagaaaaaaagaatagaaaacatatagataaatcaattgaaattatccattctaaagaacagaaacaaaataaatgaagataaatgaacagaacctcagcaacctttgggatatcattaagcatatctacctatctagctatcggaatcccagaaagagaggagacagaataatggacaaaagaccaaataatggctcacagtatttctacattttggctcacttttcttatatattcttcttgatagttaccccctacctgaacaaatcgagtcttccttaaaaaaagacaaaaaaataaaaaaactagctacttccccaaatgcaaatttaataaaagaaataaatctacttattcaagaagcccaacaaataccaagtaagataaactccaacagatctaaactgacatattataatcaaaccatcaaaaaccaaagcaagaatcttgaaagaagcaagagagaagtaactcatcaggtacaagtgatcatcaataagaataatatcttatttaaactatagaagacttaagacagtgaaatgacttatttaaattgctgaaagagaagaactgtaaattaagacctatattaagcaaagctatcctttaaagatgaaggagaaatttagacattcacaaataaacaaaaggtgaaggagtttttcactaacagactggtactgtaagaaatgttaaagggagttcttcatattgaaacaaaaacacactagacaacaacttgcagctacatgaagaaataaaaatcaccagtaaaggtaactacataggtgaatataacaaacagtattattgtaatttcagtttgtaactcctcttctttttcctatgtcatttagaagacaaatgcataaatcaataattataaatttatgctaatggggacacaatgtgaaaacatggaatttgtgacaataacaacacaaacacatgggagagacctatattaaagcagagttttatatactattgaagctaagtgggtattaattcaaactcgattacttataaatgtaagatactaactgtaattccaaaagtaacctgaaagaacaagtgagaaatgttcagaaaagtaaatgagaagggaaccaaaagggattacaaaaggaaattaaattaataacaaaaatgtaactaatatgaaagacaataatggaggaattaaggaacaaaaaggttataagacatcagaaaacaaatagcaaaatggcataagtaagttctttgttagtagctactttaagtgtaaatgaattatactatccaattaaaaggcagagattagaaaatgatccaaatatatactgtctacatgagactcattttagatccaaagacacaaataggttgaaagttaaaggatagaaaaagatatttcatgcaaagagtaaaaaaagaaaaagctggagtggccacactaatatcatacaaaatgtactaagtcaaaagttgttataaaagaaaaagggaggcattatatattaataaaagggtcaatccctcaggaagatgtgacaattaaaagcatacatgcacctaacaactgagtcccaaaatatataaagcaaatttgacagaaatgaaggcagaataaacagctctacagtaatcataggagatttcaataccctattttcaataatggataaaataactatacagaaggtcaataagaaaataaatgacttcaatgatactgtaagccaactagacctaatagagaaatacagaacattctctggagctagatatggatgatggatatacaacactgtgaatatactaaatgccaatgaattgtataatttaaaatgtttaaaatggcacattttatgttatgtatattttatcacaataaaaaacgtttacctattgatatggtttggatctgtgtccccacggaaatctctgtcaaactgtaatcctcaatgttggaggtggggcctggtgggatgtcatttgatcatggcgcagatctcccctttggtgctgttctcatgatagtaagtgagttatcccaagatctggttgtttcaaatgtgtagcacctcccccttctttctcttcctcctgctctggccctgtaagatgtgcctgcgtccccttcacctactgccatgattgtaactttcctgaggcctctccagctatgcttcctgtacagcctgtggaaccatgagacaattaaacctcttttctttgtaaattatacaggctcaggtattttttttatagccgtgcaagagtggagtaatacagctatggacactcacaaggaaacaatgcattattagaagggattaaaaactatgatgaaaaaagagcaccaaattatttaacttaataaatccatcacttctacaaacacaagacaactgtagacatcccagttctgaggcaggagggtataagataaaagaagctgctaaaaattagtagtccatatgaaaataaaaacaaaagctaaaaagtggaaaaccatgaaaaagttttctgtgtgagaaagaaatgagattggggtacaaaggtactgctttttaaatgaagaattctaaaatgatttaaagctttaaactgtgtgaatgcctaacttgttttaacatcaactgatgtttaatattaatgcaaacatcaattaattaaacactccaacccctcaaatgtagtgtaggaaaaaccatactcacttcttaggctcagtattttcaaaatgattggatcacatccacgtctttctgaatgcattcagctacggtcacttagttctgcattggttttgtgtctgtcttaatagcaatcactccaaacctaatagtctcagtcacagctctcaagtatttttctcttttcccaaatcattctcattttattttgagaactatctcccttatagtaatctaggtttatgagtcattttcaaaatcacaaagtgctttatcattccactttttgaaaatctctagaatgtaagtattttggaaaaaatcttggtattttccaccttgtgagtctgctgatgggcagccagtaaagtcagtgctgttgaattaaaataggcaacacaacaagacaagggacattggtcatgcaagtcttatttcctgaggcacaagactttgaaatgagtcgtacaggttttacgatgatcaactctcagaggccaaggcccactaaactaactatatactaaaaaatgagccattgtaaaggaatattttcttgtaattttaaattaaactttttgggggtggtcttttataatttttaattttggtggtaatcctggagtttatttgcactatttttagtttttaactttttttttttatttttgagagttatgggaatgttagtgtttcaacctgtgatggtagaaaacacattttaaaataagacagacctgggtttgaattacaaagaacttctaagtcatgtaagcatagataaattagtgtcttttcttaccttcggttttcttctctataaaatgataatgtccagttttccttgttgtcatgaggattagaaataatacagataaaagagcaatcacggtatatgacaaagaacaggtgctcaaattggtggctttatatttatagttaaagcatagaagtattaaagtcctcatgcctcaattagaccagttcttacattttaccagaaaggaagctgagaatcaagaagagtgatctgacatacatcaataagataaagctagataattccagagattagtactgaggtttcctgcttaagcaacaatctcttccttcccttgggctctcttcactatggatgaagtctactatttaaaggaaagtttaaaataatttattgaacataggagaaagcatacctcagaatattcggaaatgtgacttagatgcaccttctgagattgaaacttgaccaaagatgacccacattttctgaagactttgccaatgtctgcttgttagtgacttggaaaaagtagatactgaatatgaaaagtacaatttcttcttgcccttcattaaaacaaaataaaaacatgttctttactccaagactaagtctgacctgctattatatttgataaattaaagttcttctaagattaaaaaaaatccctttagcaaattgttccagctaacatagtacccagcatacaataaacatttaataaatacttgttggatgaacaagtgaatgtgtacgttctcataatgctaatgagaagtaatgattaaaacaaaagtataaataagaatgacagaaacatcaagcattctgatgaggatctgggaggggggagtctgctatgagaacagcttgctcagacagagaaacaccaaacgacttcaaaaaaaaccacactgacttgagttctggcataactacctcactgcaggcaacaaaaattctgctttgcctttaatcaatgtaatgaaactgtgccttaacatgcttccttatttgcatatctcttgtaatccgtgttgcatacaatacaaaaagatttattataaagaaattaatatatcttgagaggccatccccatcaggcaaaagacccatctgaagataaaaatcacaccatttataaaaaccttagaaagatcttacaaatccatgaattatttacttaaaaacttaaacatccagagattgagttctcagctctcattggcaaatttgctcctctaaacatttcctaatgcacatgaaaactatttccctgagaatccagttctctaagtagtcgagttatagagtctattatagatataactaaagattctcaataacttttaaaaactaaattatgacatagtctgatgaagggtacatttcaccttataaactgcttcatattgtaattcaaattgtaattagactcttcacccctaaacagggatgttatccccacaagtttcactgtacacaaaactgaatcacattagcccaagccccggttacccttctcctaattagaatctttgcttctccccagtatgaatctcacaaggataccagaccaatctcattagaggcaccacagtatgatgtggtctttagaataagatatacatgggtgaaatgtggcttcactccattttatctgtgagctcttggatgaatctcttatctcccttatgtctcagtttccttacctgtaaaactgagataataccaatcttataaatttatgaaggagagtaaatgtgtgtgttgtctgtaaaaatcctggcatatgataagcacataataaatggcactggctattactatcatcatcttgtaacatactggtttctcatgtcacttcatacacaaaaaccacaataagatacccaggtcatatcaaattaaattcaatctcttctattgtgtttttaatgctttctatattctgaccagtttcatcttctctcccagaattccagagcataaattataactctggtcaatttagtttccttttaatctttttcacttagcatgtcaattcctgcatgtcaataatgttgctattattttctttcactttgcttgctccattatgccaggaccttcacattccttaagattttagatcatgtcccatccatttcctctatgaaacagactcttaatgacactagctcactgctttcttctctagcttctagggccaggtcccttagaggaactgggaaaggatggaatttctgtgtgatgtactcacatttttctctatgagagcctgctcttctttctatgtaatcctatcactttgagcatttattttacactgttatggaggccactagtgaatactaaagtaattttcttttccattgatgttactaggattatagtccaaagaaaggatgcatctatgtttatgcaaattaacttgatttcagctaagcttcttattggcacactgggttctctcctgcttcatgcaagataaaagaagtatcacaaaaatcttatgaactaactggtaaatataagttaaataatagcacagtgtatatactaacctcaaagaatattaataaatgggtctatacaaccaggaaagagatctttagttatatatcactggggtctgaaatgaaccaatgaccctttttctgttcattagagacaacatggggtagtgtggcaagtctcatatactaattcctgggttctactccacatactctgtagagtaaagcctagaaaacatatgaaaatgttccttgtatggttttggatgcaccagaaatcataaatatagtggtcaaactacatgcttcaaaaccaaagatctgaattcagagtttgtctctgtctttttgtttgtacgtgatgttgtacttacctgaacctcactatttcctcatgttgagtgttaagtgacatgatgtatgtatagtgtctcacatataacagacactcactaaataggaatcatttatctattatttggatgaatacccaaaagaaatgctcattgaacccactgttgtcacaccattaagaaagagaatgaatacaataaatgctaaaatgactttgagtctcgtactactaggccaaacacccataatattaacatggataagattactaagtggatttaggttgcaaaatcaattgcataagtaaaggataggagacctgcagaataataacagttgacaggggagaaaaaaaccacccagaagtttttattgactttaagttcagtaagagataagtatatgactcaaacaatctttgggataggaaatagaaagttgggagggtattagcatatccaacggtgtttgtaccttccacagctcttagtacagtagcttctttacagaaaaaacacaaaggcattataatgatgtgtgatgtcaataaaaggtcaatatgatcactgtattactattaataactaacagtatgatatctaatacttattgagtgcttattttaggcaatataatatgccaaatgttttgcatgtgttatttcctttaattgataaaacatttatctcaaaatctttgtaaataaccatttctttgaatccccaattttaaacccagacagtctgtgacctaagagagcggaattgctaaatcatgatactaactcccatttaataaggtgactgtgcttcaggtttcataattggtaagtggagattgggatagtgctagaattatttccttggctttgatgctaatttctctgtgcaattcactttaacaattacttcagatctgcaatttgaagtatttgcagtcttattcattgttttcctgccacaaatttattccttaaccaaagtttaggttcattctgttattttaatgcctttttagttgtcttttgactaaaaggtgagtaatactaatttgggagaatcatattattcagaattagataagcctcactgccctgcaaaaagaagctcacttctgtttgcttggctttctgatttggtggcctctgcatggagattcagatttcatttctcatttacatttgtcgttttgtcttctaatagtttgcccccttataataccatgtttgctaataactctgctttcatgctgtttgccaatgcagaagggaatatttttctttaatacattacatttcttccctccctacttaagaactatttacccagcttacaccatgtacctgtccatttatttggaatggtatatgttttgggatccttttatctcctttccatatttgaataattatagttattgatctctgtggcaaacctacccttcgtagtgttttatttatatcttttaccttttctcagtgaagagaaaaggatggaaattataataaaattattaaaatttataaaatccagggtctaatcagaggacagaaactacaataattgaacaggaaaagtttaatgtataaagaattagcaactacaacaggggattagaatattgagggattggtcagtaaggagtaaagggtactcttaaaatatacaggaataacagatataaggaacagccactactctagaactgatatagatgcccaacgaagacgcttgcctaccctgaaggctgagatctggaccttgtcagggagggcacagccatggcttgtggaatggcaggcactgaatagaatgctgtgccagcgtaagttgctgaagatctgcccttcagaactttatggaaatctgctctctagaatgccagggaaaactgtttataggcatgtgtctctctggagtctctcctctatgaaattgtccaaagtgggtgctgctgaccaccacgcactggcattgtgcgagcctgatggtgcagttgctgtttacactgaggagcctgctgagagagcatgccagcatcaggaaggaaaattccttcctcctgtgcttcaattgaccaagctgaacgttgtacacgctggcaaaggaaaatatttaaagggctcatctccatttttgcagaacaggcaatggagtataaatttgcagatgagatacaataacttgataactggtacaccaggtaacctgtatttaacaggaatcctggagggccatctggttcaatttcctatcttccagcagattgatgcctaagctatctaagacagatggttgttaatgctattaatatttaaacatgagttccctttaaaacctgctttactctttaaaaaccgaagccagttaagtctatacgtgtttactagagagaattttggaaatactaaaaaattataacagaaaactaaaataagctataattccagaatttagagaaaactaatgctagtattttggtccatattcttctagacttttttttttttggctactcatgtattcatttaaaacttatttagcatctattaggtctaggcacaatagtaattgttaggtgtacagtgacaaacctatcaaatgcctcctcgtcaactgagaatctagtgaaggaatcaaatacatctatttatgtatatataaatatgtataatacatgtatctatttataacactttttaataataaaattgggttcattttacatatgctgatttggattcagctttattcatttaacattatattaaaaatattttccatgttactataagtttttggaaagtgtcatttttttcatgactaaataattaaattttatcatttaaatatggtttgatttcccttttttctattgttaggcaactttttagcattttaaataatacactttgcattatacccatccctgcatgatagttaaccctgtggatataaccatgctcctgagtttaaatctcatctccagcatgggctgagtgatttagagaaaaaacacttaacttctctgacttcagtaagatcatagtacctgcctcatctgggtgttgggtggataaaataagtttaatatacagaaagcacctagaacgctgcctgagaacataagctatttaagtattagtattatactcatcatctgtttatgtgtctgtgtctccctgagatgtaattgccttggtggttttgcctactattatgtccctaacacataacacagtgtcttgtccatggtacaaaatttaatacttatttaataaattaggtgaaaaaaccctcatatataaatcacattactagttgaaagagtataaacatttttgaggatcttgatacttgctaaattacatttcagaaaagtatcaactcatattgtaactacaatacatgataagaatgcccttcttagcctgctcttagacattagatattacaactttttaatgttttctatttttttcataacatattgcattatactgctgctttaatttgtatttattcaattgctaatgaggtggaacatgtttttccaattgaatactattcttcaaattgtctattttctttcccaattttctactaacataaggatgtttttcttactaatttttaggaattccttttattgttaagatagttaccatttttttaatttttatataggttaacatttacttcttaattttcatacactgctttgtggcattcagctgatcttaatttttatgtagtaaaacatattgattattttctttataattagttgcatgattttattactagacattctcccccatgtagaagtcagtaaacacaagacccatacttcattcaatgttatttgaagttaactatttaatccattgaaatttattttaccccctctaaatagtgactattctcaatatcatttgtataattcattcttcccataacatgttgatgcttcccctataaaatatcatggtttttatatttagtagggtttttatattctattaagtttcataaatttctacattctactggtatctacaattttccaagtggtaagtttaattcattacattttcatatttagtagggtctttaaactctactactttccatggatatctagaccctactagtaccacagtttttaactggtaagtttaacacattctagtatcttgccgggaaaagttcctgcctgcccctcactgtgcatgtgtgtgcatgcatacacacacacacacacacacaggcacagaattctactccatcacacatcatccaaacaacaaatattatagaatgccctatatgtagtcaggaattgtgtcagatgacatgaatagaacaacaggtaaaactgacatagtcccatcccttatggagctaaaagaatgtggaggtagaactaaacaaacaagcagggaattctactacagataggctatcctagggcaagtagagtatgctatgagcagccactggtacagccatgggggagaaagaaaagcttgccacagaagatgaaatgaaactaaaatctaaagtgtgtgagatataaagagaaattggccaggcagaaacatcaagacaataatgaaataaagaaattgatctctctaccccattgttcttttcaaaattcttttaaatatatttcatccatttattcattcaagttgctctaatgatccagtatctcatttggtttggaagctcgggatgaaatattgctctgttatccaactttatgcatttcctctataattcaggcacttgatacaaactagtctactacttttatatctggtatctacccttaatgtacatgttagctcccattttcctacctttctctcttgttatatttagtaggatattttattatttaagtagatagtttcatactcattattctccagggttcattgcttactacctatgtggcttgaataaaaccataaataattactttctaaaaagattgaaagaaatatttgtagttaagtgtgccaagagcataaaaaatacagcttataaaaataatacaattattctttctataggagtgctgaggcttatgaaaatagtttcttattgttaaaaaagatataaaaaatgttcctttaaatgaatgatttccatatataatcagcttaacaatatctttaaaaattgtgttcatttacataggtaccactcacctcgtgtaacggggaatgcaaaatatgatgtcattaacccattttgaccaaatatgcctaaagaaaactaatgcttcaagtatcgatcaacatttaacagtatttttaatctttatatatttatttcaggcaggatactagttaatttagtgtaaaccacgtttaattatttctgtttattttatatatcctgatagtaatataaataccaattacactttttacagtcttgtttctctattctttccatggttttggtaaagtgttaatagtatttcattacatgttttcacttgcagggcttgctgtagaatacagctcagtttaaacagtcaattaattttagcagaactgaaattgaatgatgaaatatttctaggctgagaagaaaactacagtaaactcttagcttttctactttgaattggaatttttgctctttttcacttctcagagaatacctaatcccgactaaataattaactgactggcagcaaaatgcattaattgtggagaacagtaagctgggtttgacatccatctttgtcactaacagaatctcatcatggcaagagtcacttaatgtcttcaggtcacactattttattatttgtgaaatgaattaataggattacagactcttcaaagtccttactacctctaaaatgttaaaattctgactctaccttgtacataaaaagaaccagtaattccagtgtgagtgcaggggtttctaaaggccaaatatcgaatactaaataatatactatacataattgcatgatttgttcacaactattcatcccctccctcatcacagcttctctgtggacaaagtatattccctgaccactgattttgggctggtccctgtgatttgctttgacttatgaaatattgtgaaagagacagtgtggtaatcccaagaaaggctttaagaagtgctacatgcttctcatcactttcttaagattatgtcctctttcataagcacagcatgtacaaaatagtggttttcttgagcctgggtctctcaatgaaaagatgtgtggaatagaacaactgacccacgccaagctgaacctagtctgagccacttgcaaacttgtgggcaagaaataaatctttgttgttgtaagccattaagattttgcggtttactggagatcattctgttaagtgaaacacgccaggcacataaaaacaaacacacattctcacttatttgtgggatctaaaaattaaaacaattgaactcatgcatataaagactagaaggatggttaccagaggctgggaagggtagctgggggactgcggggaggtggggatggttaatgggtacaaaaaataatagaaagtatgaagaagacctactatttgacagcacagcagggtgactatagggtgactacagtcaacaacaacttaattgtgcatttaaaaataactaaaagagtgtaattggattgtttgtacacaaagaataaatgcttgaagggatggatacctcattctttatgatgtaattatttcccattgcatgactgtatcaaagcatcacatgtacccccataaataatatatacctactatgtaaccacaaacattaaaaataaaaaaaattaaaatattttgtggtttgtcatcacagaaaaagttgacgaatcaagtactaggtgtactttttagaaaactgataaaaacaaactatttttgaaagtctcatttcaaacgctttattaagtaactccttattatcagggcttttgttccttccttgatgcctggtattgtactgtatcacctaaattaaacataggaaagaagagaaggaaaagtatgttgaatgggaagttaataatgtgtctctaaagctatttctcagaattagtaagtgttcagagtacaaacagatgagaagtttggagtcaaccttctagcagtgttgtcaatatatcatcaatatgatatggttaataaactagctttaatatgattcagtgaatcttgtctgtttctttaaatttgaatatctatatggcattttcaaattgattgaataaatgtattattaaaacctctaaaatcacataatcattgggataactcgtgatttgtttacactttgtaatagcacactgggggtgggggaaatgatgaacatttgaccacatttaatttcaaaggaaaaatttgaatatattttctgttcgcatttccttaacattcacataagtaattaagatgactaaatacttatatcagtacatgaaagcatctatggaaattccaaatgccaggaagaaagtgaagcaaaacatatatgccatgtaggaagataattatacattttaaaagtacattatcaatccaaaataattatgaagaaaatcctaataatcgacttcattgtagacaatatcctaacacatcataaggacattgcacagcttagtgaaatgagatagcatattgctaaaatctattggtgtcttaaaaagtggaggggattttatgacaactataaccttagcaattttatctatacctataaaataacttgatataataaaaccttatactcaccgccaacattagacgagttaaaatttcctgtcagtctgctgagagacttcattatacattatctttacatatattatctcatatccaatcttcataagaaagatcctacgagaggggttctgtcattgtccttactttatagataaggcaactgaggtttagaaacataaaatacattgcccaaactaagtggctaaaggtcagaaaatatgacttaagaatttaaattcttcatgttaaagtgtgcctaataaatggaagagatgaaaaagtccttcaggtcataagcttaatttgaagatattaaatgtctgtcatatccaaagttacatagatggaagcagaaattaaacaagaacttgaattttttattacggtatcttaacacattttactatatatttataaaaatatctgctataaagttcttgaaattttatttccaagcatgtattttacctgcaaagtttcagggtgatttttatagtcccatatcttaataaacgcagtcaagttatctgctaatttttacattttctcctctgaagacagctcaacaacctctaaaagatacattttatcccagtagggggtctaggagcatggaaataattaagttttaaaatgtctttgttattttattcatatttgatgacttaattaagggaattatgagataaatacccaaagcaagttgatcttaagagtaaataattattatttccactagggtcgaattgcacatctcagtgatgtttaaaaattattgtaacatggaggatggttatagatatcctattaaattgtcaaacatattgcaaagattaggcaaatttttttcattacctcattatggttaatgcagataaaagactccttcctctacttagcctataaaaaaatgcttagaaactaaatgtttagaagacttcacaaattccacttttagtaaaaaagacaagtgatagaataggaaggtaaaacttaaaggagaaactagaaactaggcagtaaaggaagggagaaattatagaagaaattatttcccttaataacaaatatttcaataaaatgtatttagtaaaatctttaacagacttgttcattattttaccattgacttaagtaaaaaagcagatgaaatgctatgattaacaaatgacatgatgccaaaggaaataaataatacagcgtataagtgatacaggctaccaagaaatttaataaggtgaaatttagaagtaataaagacaacattttgcattgagatgaaaaatagtcagcattccagcagaggcagatttaccacacaggtcatgaagcttaagcttcaggacccttgatttacaccaacacctttcagagcctgtacctaatgtatatatgataatcctattattaaaggggacctctaaaattatataagcttccgacctccaaaaacctgactatgcctttaagttttaattccaataggataatacaaactatttaactctgaatccaacaaacctttatgcaacaaacctttcagatcaaacaaggacaaataaaatcaccataacccataccagagcatatcttagagacagaagccaacttacatgtaaacgggagatatattcatttgagaccaccaaagttggctccagagcccttaccttagtgagatggaggggacttgtatatataagaggaaaactaggcatgtttccaaatagatacaattagcctccctctcaccaaggggagggctctgaagccagctttggaggtcttaaatgaatatctctcccacttacatgtaaattgacttctgtctccaagaatgcccccaaaaggagagagtccaatcagtaccacccttaaagtttgtaagatcctgggcaaatattttattttttgcaggactcctgtctatataaacagtttgattaaagatgtactgcaaattcatggactcatgcaaagtacagtgatttattaatgaagagttagaataatgagtagacaagcagtatatatatatttgtttattgtacatgtttattgtacaatcagtgcacatgaagattctttgtagtgtctgattactgcctatttctgttcagatccagaaaccataccttcatgttccctattgtcatatgtcccatgcctaactacttccgcatctcccatctgagaaaaatgtagcaatgctattattgttactgccatagctctttggaaactgtgtgtatttaagcaacacagaccattttgtacctgtagttctctaatatcatttacttaatgctgtacataattactcatgacactgcatcatctatcatgcaccctgtggattctgacttcggtgactctcttgaaggttgttatggcattgatggtcatgaacgcaagtcattcccagagtatttcagataatgtgaatgatggtttgttttctggtcatgtttttactgatggtagttttatatcataaacttatcttccaaccatgtgtttcctcaactatttagatcaaaaccactgcattactgattgcattgctgactgcttttgattattgctatactcccaccttccacaaactgccaccaatgaggaagatagacaagggtcctaggggcagtgagagaagagactttctatttctgtaaatgaatgtccattgttcattcagcatggcttagaattggtccccccaccccaaagaacacaatatcactgcatcaattgtagaatactgattgaaaggatccactggccatgctgagcaacaatctagaagagtcttaccggaaaacagaatgatcattcccagaggactgcttgacatgtggcatggagcctgcagagggattggggtaagcatcttgggtgccagtggctgggagtacattgggttgaggatacctcctgcagctcctgccgcccacaagggctgcccacatgggcagacacacaccagtgagcattaacacagaggcccaaagctcaagcccaaaggtcagtgacaaatagttggtagcccagagctctgaaactcatcctatgtcagacattgagtcacccaagtacatatatcagcacaatctgatagaccaatttcatgtgatcccacaaaagaaatactgtggtagccagcaggagggatccactagccaggctgctctcctgaaatcaaggctggccatgggtcctgggacaactcagaagggtgtgagccccagagttcttacaggtcaggtggatgattccgggtatagagagtggagagttgtagagtgcctcaaaggtaagaaataggaacccgggcccatatggatggatcagggcccttaaggcacagggcctgaggcaaaaactacacttccctgggcctaagggtggttctgggtccaattctaaatgagaaagtattcagaacaggtctgatccctggggatcagagtgctgaatgctggggagtcagaagcaacttagcgggcaagaccagaagtggcggtctctatcaggtacctcttctgatggagaagggggcactctaaatattaatagtacaagagttccttggaggtttgattacaaaggagaagaaagaagttgcttaaaatagggtcgtactgaaacaaaattgtataaaaaaataagaaaagaaagagaataataaaaatcaacaaatgaaaaaataaacaattttttacatcctttacatgtcaacagaagtagcccttggactaagaaaatcagcgtcactggacctggatctatttgccctaagagctcatcttttctcttcttctgttctctgtattacagggggcagccccctctggactgtgtttctctagactcccaaatcagccgggctctgggtgggcttgaacagccatttagaagcacttgtgcaagactggaaggtgttaggaagggagaagtcaggggtatttctctccctttctttctgccttgggaagtatctccattgatgactgtcccttttttatggttccattatttccttggttttcttggttcccgggctctgataaccaccatttccttttgtctctcagcctcaggacactaatggcttcttgcttttgctagcctgtaggtcacctcgctgcccccagtatggctcctctattatttcatcatctgtgtaactaactctctgctttatatccctgtgttgtaaacctctataattaaaacagtgtggtattggcccatgaatagacagaaggatgatgaaacaaatagaaagtccagaaatagacccaggtatatatagaaattgggtatatgacaaagttggcatctcaaatcgctgggaggaaagatgatctttagaataagtgatattggttcagcttgatagacatttggaaaaagtaaaaaaaattgaattctatcttatacattatctcaagattaattttacataaatgtaaaaaataaaaccatataagatctagaggaaaacacagtgaaatcccttatatcctaagagtgagggagcctttctaactatgactcaaaatacggaagcaataatggaaaagattgagaaattcaactacttaaaaaaaagaaatggccaaaaaaaatcatcataaacaaaatcagaggacaaatcacaaaccagatgaaaatattgcaacttatatcacaggagaaggtctaatccagtgtttctaaagctcagcactactgacatttggggatggataattctttgttatgggggctgttttctgcactgcagggcattcggcagtacttttggcctctacctactaaatgccaatagcacccctttcccaggtgtgacaaccaaaaatacttccagacattgccaaaaaacgtggggagaggagtgaggagggaggcaaaatcatccccagctggggaccactagtctgttctaatatataaaaagatcttaaaatagtgaaggaaaaattcaaaatccgaatagaaaattgggcaaaagacgtgggcatttcataaaaagaagagaaatggcccctgagcacctaaaagattgcttaatctcactcatactaagaaaaatgcaaatgaatgctattctgagagatttcttacctagcagattggcacacatccaaacatttgaaagaagtctgtgagctacacattactgatggaagtgcaaaatggcaaaagctctttgaaagagaattaatcggtattttaaaaaattatattcagattttcttttgacctaggaaccccacttctatgaatattccccaagagagagagttccaggagaacaaaccaacatatgtacaaggttacttactgctgtaaaaggctgcaagtaattcagatttccatcaatagcaataatggaataaacaatgacatactacccaatgaaataccataatgcagaccttaaaggaagtgaagactgtctttatgtattgataagaagtaatggtcagaatgtattaagtggaaaattcaaggttcagagcagagtatgtgtgtgtgcttgtgtgtgtgtgtgtgtgtgttgtaaaaagaaaattcttaaaaatgataacatagcggatgaatgggaggaataaagtagggaatagatggaaagaagaattttctgagtacacctttttatataattttgacatctgaactatgtaaatgccttatataattttacaaatgaaaatagaaaagttaaatcctaaaattaaaaggaaaccagaataaataagcctaactctattttaaattagtaatacgactcggagagaaaattatttcaagtgacttttggcaaagcattctgattatatttttatgactacaattttaggatatactgtaagcacaaaaagtgattcaaataaattttaaatttcactcaatagttttgttgtattggggacacatgaatgtaaagatgggaacaacagatactcgagactactagaggaggagggtggaagggggcaaaggttgaataactacccactggatactatgttcacgacctaggtgacaggatcaatcatatcccaatcctgagcattatgcaatatagccatgtaacaaacctgcacatgtaccccatgaatctaatataaaagttaaaatttagaaaaaaataaaataattaaaaagtatttaaaaatagttttgttctcattagaacctactttatatgctaggataaaacaaacatgaatgtcttagaaactaagattttcattataaaagaaaagagacaatataagatcaaagttagaaacttataatattaaaatttaatcaaaatccttcatatgcagtaagtattatatatgcattatagatgtataaaatatatgcgtattttttcttgcactatctgttgtcatttattgtaaaacactgaacatataaaaattcacaattttacagtggttgagaaaagaaaacggaaaagaaaaaagaataagatgaagagagtgatagagagacacacgactatcaaagctcactaataaaccaacttttcactctaaaatttgacaattaaaaaaataattcagaatatcgcacctttttgggaaaagctgtcgccaatacccattttattttggaaagctctttataagagattaacagccaataaacgtagaaggaataatattattagagaatcagaattttgcaatcccaatgaaaccactgttcccatcaaggatcatcaaagaatgataaacccttacgtgaaagttcactggggaatacctgatgtcattcccaacagttcatttaccccacagtttacttgctaattgcaaagggcaaacagaccttgcaatgaagtgatctagtagtaaccaccctaaaagtgataaaatttagcatgaccaatagagcgaagcctgatattttatgcttcctaatgtgatgcaatataaggtactcagaatcacctatgaagtaccatactcttgccaaatgcttaagctagatgtgcccaagactttggacctaatatccaggttataaaaagtacaggtataaaaggacaagttaaacaatcagacaaatatagaatgtgatatattttacaagacaattgtcatcatctcaacaaaaagtcagtatcacaaaaataaatgttggtggactgttctagacttaaagaaacttgagtgatgtaacaatcaaattaaataagtgaactctggatcctggtttgaaaaagcagctgcaaggtcattttggggaaaattggataaattagatagacagatgctagatgaaataggctgattagatatcacttgattaagaaattataattttctcagtgtgcaaggtattacggttaagagaatgctcttttctatatgtatactgaaatatttaggagtaacattatctccagaatttattttcaaatttttcagcaagcaagatagaaagatagataaatagacagatagataaatggatagaaagatagatagatagatagatagatagatagatagatagatagatggacggacggacagacggacggacggacagacggacggatagacagacagacagagacagatagatagatagatagatagatagatagatagatagatagataaaatatggcaaatgttaactcttgaatgtaggttgttgggtgatgggcatacgttaattacactgttctttcaacttgactgtttgaaaattttagttaaaaaatgtggtgaagaacattgtacaaatataggatgagatacgatagaacataaagaagacccttataagtgtgtaggagattagtggggcatgattgttattcttagattacttaaggaggcacaaaaaattagtcttcagcagctaacggcatagatatgatagggttgcactagatccaccttctagggccaaaaaggcactggtggagctgtctcagctgtcagtgctaacaacaaagttgattagacaaagatctatggatctagagtgcttggccatgacttaaaaaatagagagcatttaggggaaatattggcagggatagcctgcctcagctattattgttatggcttatggaacatgatgatgggtacagcaccaagaaatcctgtcatcatggacctacaaacagtaaggatttaggctgagttttagcaaagggaataaagaaagcagctagaaacccaagaaggccagtggatccagatgagttactagaatctctttaaaagacaggcaacagacacacagacatgcaatgaattcaataaaaattatatagtcacagcacattttcccagtctcaggaggtttttgccctctggatggaaggtaattgtttgttaataagtacctggcttcactacacatacactagtttcagggtgaaatattactttaattaactagttgaaatttcacaggtctagaatttaattacctgttggaactgtagctaagatatcatggtctcataaaattttactgccttttaaaaatgaccataatttatcagaatcttgggggaaattgtgcattgtgcatgaaaacaacaaacattggaatatagttagtcctaagattgaagaagagacttacaagtacttcgatgcactctactgaagttcagatgagaggacagattctgtttcagtgacaaagacaaactgggtttcatattcactgttgtcttcaccttctgctatagagtttctgggttttttgtttgtttttgtttctgttttgtttttttttcttgctaggctccctcaaatcatgggacagtttctggttttggaccccaaggaaaatctgaaggtagatgaagttgtcctttgtcaaactacccctgctttttttgtgtgtgtgttagctcactttgtatggcatttagagcctgtatgtcctaatctatttcttcattatgcaaagcattgaatagtttcccagattctaattgtccttgtctaggtagcatgtgtaccagggtattatattttactgtatgttgtctctacacatgccgcaccagattaggctcccaggaagccctaaactcttggtgatagtttgatggaggaaggagagtaggatgaagcctttcctagtccctgagctttagtgatctctgtaaacgcacaatttaagagataagacatgtgagaagaagggtaggattaaagatctgatgaattagttgctaatctatttcttaggcaagtaaatttatccctcttggtatgtgtcaacttgtctaggtcacagtacccagtatacacatgtgcacacacacacacacacatatacatactgagagagagagagagaatttactggttttgtatctctgaaaaagcctaatacaatgtactccctcatctgtgagaaccttccaaattcttcagttttacaatttcatatctaaagaacaggtctttgttgctaaattactgcctgaaaatagttaagctctaattattaaggaaaaaaacattcctgtgaaaaatattttctttccacttataatgcaaaggtaaacttcaccagtatataataagaataaattattaataaatggcacctgtactaataataatgctttactatttgttaaaatattccatagtactgaagacatttaactacgttagtaaatgacccaaactaacactattattatttctttaaaattggtgacacagagggatgactaggcaaagcatagaggattttcagggcagtgaaatattctatatgataccacaatgatggatacatgtctacttacatatttgtgtaaacccatagaatgtacaacaccaagagtgaactctactgtaactatggagtttgggtaataatggtgtgttaatgtaggttcatcatttgcaacacatgtaccactctagtgggggatgttcatgatgggggaggctgtgcacttgtggggagtagggaaatatgggaaatctctgtaccttccactcaattttgctgtgaacctaaaaagaaaaaatatgtcttaaaaaaaaaactaatgacccaagtgtgaataaaacatggattacatagaacttaagggtttaaaatcaacttgcaccatactgaaaccacttagggttcttatcatgctgtgtttcttatgattcgtttgtaattagtcagaatatactgcagctgtttgtgatttcagggaagaataagatgtttataaagagaaaatgttccattatctctgctttttaaaattcctttctttgtaaatgatattttatgatatgttttccatcctcatttcaaatcctaaacaagactgttaaataggggtttgtcatacatagaaaaattgctacatattagcttctttccccacttcctcccctagttttatacatccatacacacactcacgcacattatttttatatgcgacaatttctggctctgcataaaatgttactgcaaaagtacactgtgtcaagttttttcagctgcttacattcctactctggtaccagtgccagggtttcagggcactacaatttcctttatatctcagtggttattttgaaattatcatgtctcatctgcactccctcataatgtatgccttccatgtcatattaagctgcactcttttccctgccttaattccctaatttctggaatgatattggaattggttatgattaaaacagcaagggtctatattaaaagcaagtatcttcctcatagatagatcatgaaagtttgaggtaccatgaaatatgatgtgaaaatcaccttcttcaaatatccaagaagatcactagtaaatttcaagtgtaggttcatttttacatatatcttacttacccctggagttccatagcagaggtggtagtgaacttgaccactagtgagaaataagaggaactatggggtaattgttcccaaggaaagggcaggaataggccattatgtgcatgtaactgtaaagagtcagtagatgcatcaagaggtatcgtatgacaattggaagatacagaaataaattcccagggtttcaagataattgggagaggaaaaaaggaaagacagtgtggtggacatcttttgtttttgcttgactagaatcctccttcattagtaacagcatctgagaaactatcccttccctattagacgggtaagagtctcagttgcaatggcccatcctcccctgaccaagaatgtagatttggtccaatacaggcaagtcagacacttcatgggatatgaatctttaactgaacaacacaaaggctgaaattttttccagctgatttatctcaatgatggtgttttaaagagactttttcattagtttcttctccctagatatccctagttgctccagttactgctctttttgaatacttgtttcattttttgttttttttttaaatcctgcttacattagttgcatgcaatcttacaagcttaactgacaaatcattaccaacaaattagatttctttagtgacttggcgaaagtgagaaagaaaactacctttgagaaagggtggactggattaaagaatgaaaactttcagccaaatagtagagaactttgcctaagaatgacttagaactttggtccacttcaaggaaaggaaactaagccagaatgtaaatcaatgcattgcttctttcattgagaaagtcatgtaacaaaaaaaacaccagctgaactaacctggatgcttagtgatgtatttggatttacaccatgctgccagttccttacaatttcagtctcagtaaccctgatctagcttaggttgttttaatccaaagaatgtgctgattgagactttttattggaataactagaatttgacacatgatttccagaagtatagaggttcccagaaaatacataaatgaatggaaagaatagtacagcaggcccttgaataatgttgtttcattcaaatgtcatttcattataatgttggtgaggaaaaaaaaatctattcccagttagagccactgtctgtgtggagtttgcaggttttccccgtgtctggatggattttctctgggtattctggtttcctcccacatcccagagatgcacatgttaggtgaactggtgtgtctacagggtcccaggctgagtgagtgtaggtgttaatatgagtgtaccccgtgaagggacagcatcctgtccagggtgcattcccatcttgtaccctgagctgcaaagataggctccgaaataatagagtaaataattgtctggcttgtttttattaatcttaaatgtatgtatagttcacatttatttcaatgtttaatatgggaagtgttttggtctttattcagaagtttggtgatgttttagtaaccagaaatatgccatagaagctacaattttctagctgaacaaattacagcaatataagctttcttatggttatcttaaaagatcttatggttatctaaaagatcttaaatcacacatcttctttgtgtttctggtatgccaagttttgttgtttatgggtttcaatgtgaatttgtttacttatttattttatttttttacctaagatccaggaactatagatcaatgtaaattaaataaaaaattgacttggattcttgtccttgattaaactgcaattcatgtgtttttgaatttttaaaagtaaattttctgttgtaaagtaataatgacggctacctcccaatgggacacattctgttttctagagtcaatgaattcaagtccacttggagtctatgagtttggatcaccttatcttaaaggctacttggtgaacagagttgaagttttaagataatccgttagttgagttaaaaaagcacttgggtatatcagggcttcttaacttcagcactactgacatcctagagctagataattctttgctgtggacagttctgtacattgtaggatgttttcagcagccctggtctgtatccctagatgccagtagcaatcttccttaattgcccaatatgccctgggaggaaggggtaaaatcaccccaagttgagaaccactggtgtatatcattgctataagggcattggtttttaaacctgacaaagctgagctcacctctcaggtctgtccctttcttacgttgatttgggaaagttactattttccttgtctgagaaatgttgatatctcctgggaattcttgaagagattagaaaatgtacttagcttcatgactcacctatagtaaaaactcaacaaagtaatcattgttagtaatagtatcataattcctaaatcctaaatacagattttctgatctaaatgtgcaaataataactaatcaaatttccaactgtgttatttgacaaaggtataatgaactaaaactctaagacatgttaaaaaaaaaaccctaaatacaataatttctaaatgggacaaaggctttatagctaactctttgaacttgaaactattttcagaaaaatgactggagtaatgttgctttccatacataactgttgaggaaatgtactaacacagacgagatcaaactgaaaaagaattatatgtccaatgttctagtcctagaaagaatacacacacttcctctctcttcctctaaatccatagatgttagcagtgaaagatactaagaaaatgaagaactagaacgtggaatattgtcacatggaactaacataagaagtaaaatgtaaatgaaggaattttatacatgtgcatttcaaatgatctcgaccacaaaatcagagaaatgacagacgaatacatgaattatcaaaccattcgctgttcaaaaataaacttctgaactttagtgtttgcttaatggaaagttctttcttttctttactcagttatgacctcagacatgcatcagaactcaatgcatatgataaaacattatcatgccaactctgtggatacgaaaaaaaatgcatgagtggagtgacatttaaaatgctgatttaaattccttagcataaatttcaaccatctgggaattttatttgctttcctcttggatcctgttgcacactcaggtgagcatagctgttatccataaacgaacagttgttttgaaggggcagttgtacagtctctttaataccaagttcactttatctggggtgttcagatagtgctttcattttcaggtttgtggaaaggtgaagagacaaaaagctcaaatgctttgttaggaaatgctgctgaggaaaggaatcctgattattgctttgaacttcaaagtatatcagtaacagggtctcttaaaaggaagtctcttgagagttcagattacagtgaataatcttagaaatgttcctgatgaaattaaattgcatggttcaagtaatgggctactctcccatatgagccttgccatgattaaaactgctttaacactaaatcgcacatggatgccttgtaaatacaagatatttaacaaatatttctcttgatgacagtctcatctcacctcatttcagcaaattaaagtaagttgccacggctttaaagaagtcacacagctagttaattgcaccgtttgtccaggaaactcattctcctgaatcaatcccagtacagctctgggttggattgattaaatcatggatacattgattgttttaatgaaaaaagtttacatgttcatttaatctaagacaacctgcaccttacacacacacacacacaccccacccacacacctatcttttttttttttgagatggagtctcgctctgtcgccaggctgaagtgccgtggtgcgatcttggcccactgcaacttccgcctcccaggttcaagcgattctcctgcctcagcctcccaagtagctgggactacagtcgcgcgtgaccaggcccagctaatttttgtatttttaggagagacggggtttcaccatgttggccaggatggtctctatctcttgacctcgtgatctgcccgcctcagcctcccaaagtggtggattatgggtgtgagcctgagttaactaaaatgttgaaaagttaagggaattggtcattattcttcagcatatcattcttgaacaaaatgcggtttctattatactctggcttttgtggggctagcagtatctgaagaaacactgcagaaaacattgtagacagttttatttcctaggaacatcagtaagatttccacaatataaaaacttaaaaaaatattcagagcaaaaataattaaactaccataaaagtgttctttgccaacgaattgtgactagtacaaagcattcagtcataataaatcttttaagcttttcaaaagcaactccagaagctaagtttcaaaatttgtttagacaaaagcaaatttttaagaaaaagagtgtatattttcttcaagctacattgaaggcatttgcatgtttaagtaccagtgaaccatttgtttatgtttaaaaatgtttaatcacgttagtgtttttttagtttgattttattttccaaagatggctacaacaatatctcccatcccatactttcttctagaatcttgtaaatttcccattaagaaatacaatctgattcctgcccccttaaacctggacaggtttgtgacttgcttgtaacaacaatacaagatttcccaagctaggtcagaaaaggtagtacaactttcaccttatagatggaatactcaggccattcctagcctttccagatggcaaacaattctttaattaaaagagagcctcaagtcaaagatcaaatccagggtgggactataagatcatttgtgaagacttcaaaaagatctaaggctatacctcatagatcatttaagaaccacaaaaggctctctgaggatcttaaaaacatgcctcataggtcctccctgttaaacaatatagggtttctaagtatctaaggaagtgtctttcatcagacttacagggaacacaaaatagagaatggattatcttaaagagatttgtgactgtggcttttgtttaatggactgaaacccaatgagattcatagaaaatccacgaagttcttaagaattgtgttgctgaaaacactgccagtttaaaagagaaggccgggcatggtggctcatgcctgtaatcccagcactttgggaggacgaggtgggcagatcatgaggtcaagagatcgagaccatcctggccaacatggtgaaaccctgcctctactaaaaatacaaaaaattagctgggcgtggtgacatgcacctgtagtctcagctacccaggaggctgaggcaggagaattgcttgaacctgggaggcggaggttgcagtgagccgagatcacgcactgcactccagcctggcaacggagtgagactccatctcaaaaaaaaaaaaaaaaaaaaagaaaaagaaaagaaaaagagacagtacaaaatgaaaggaagcctctgaattctagaactgctataggcaggaagcaaactgagaagatttagttttatgcataggtcacttattataacaataaagaaaagattactcaaagaaagtaagactccagagggcagagccaaaagtcgtggccaactctcagagagtagaaccaaaccctactgacaaaactggcaacacgtacctggctggacttcagaatttctattggccagtgacttctatgtacctatactcttccatccatttgtaatggaagcatctattgtggttaacctatgcgtctggcctttacatgatggatatgtgggaggcaccaagaggaacagtacttgaatgctttgcttaaggaaactgacttaaggagactcaactgcaaaaggacctaacttaattagagaaataaaaggtttgcttctcgaggtctatttacagactaagaattacaaaataaaagatctagtgtatgtggattaataattttaataagcgaaagtggtatgtactttctaaagtatatcacaaatgtgatataaagagataattgagaggcagaataatgtgttggtcaaagtgcaagccctgaatcagaatggatggaatcaaatcatggctccactcacctctagttctatcaatgaaggcaagtcagttatatgctctgtgctttcatcccccatttgtaaatcagacatgacaatagtacttacctagggttgttgtgagaattaaattagtgagaatatgcaaaacatttagaaaagttcttaataattatagagataatttacctacaaaaatctaattgacaatgatgacttttattgctgaaaggaaggaaacttttaactcctctcaaattactgggagttcaaaaatgaatcttgttgagtgaagaaaattgctacagaagactttggaagtgattacacaagtacaacatagtaaagctagaatcttctgccacttgtcaaaataaactaaaaatagatgaagaataataaacactaagttgtgaatcctagtgtctacttacgataatttaatgacaataaatctaggcagatctactgggttatgctaagacattttcctagctgtatctaatttgattgactttttctgtttaattagtgaatattataattatgtgttctgaaagttgtatgaatttcataccatcaaatagcactaatgcaaaatagagcaaaatatcaagacttagagtctcttttgtgaacttgccttcttgcaaagaatatagttaactccctggagtaatccttatttgtctacataatgaatgctgtgggaaaatgaggcacttccactcttgttctcatcggcattgatatgaccttgtctgatttagttgaaccaagggcattttcaataattacaagctcagaggtctaccacagatcctctcatgggaggattacttaatgtaggcaaagtagatacaacccttcatgtctggtccattttaatttattggttgcctaaatattcaatcagagctttcaccagctatatttgtagagctgctcaaatgtttttataaaagtaagcacatagaaattacaaacggtgcttcttttcattcttgcaggctgacacctacaaaatatattttgttaggttataaatagttaaaaaacttttttgagctacaatgcttttaattgcttaattttgtagtttttagaaacatgttctagaaatatttaggaaacaatatcacatcctgtggcatcaagaaaggcaggaactttgtttttctaattaataaagaaggctaaaaagagtcagttgttaaataggcaatgggaaaccataattgtaatccatgggaaccacggatttttgctggaatataaaggatgatttaaaattagcttaagatttcactgattcttaatgtattttgttgatatattgattagaaaaaaattacatttagccacacctaaacttattttggcttgtttatcaaattttcagattaattcttgttgatcagtttcctttcctccttccttccttccttccttccttccttccttccttccttccttcctttctcatgctccacaacaaacatttgttaggcaacagttcatttactaacaccataataggtgctagagattccagtagaaatcataatctctgtcaccatgaagttcatgaatttacaataaaaacaaaaccaattaacaaaggtgggccccgaattcaatgactggcctccttataagaagaggagaggatacagagacccagagaagaaggccatgagaaaacagaggcagagattgaaattatgctgccacaagaggaggaacacctggaagctggaagaggcaagaaaggattctttcctagtgcatttggagggagcatggtcttgctgactccttgatttcagacttctaggctccagacttgtgagagaataaatttctgttgtatcaagccacccagtttgtggtactttttgtggcatccttaagaaacgaatacagacatgttcactttgaagtacctttgggacaactgagtcgaatggtcaaaagaaagatgaattcagggatttggaattccagcttaggctggagataaaactttgaggattatcagtatgcgatttggcaataaagccatataagtggctaagatcatccaacgcactgtgtagaatgagacaagaattccatctagggccatgaagaacagtaccttttaggaagagaccaaggtggaggtgctcacaaagggagactggagaggtagaaggaagaccaggatagtggaggggcacatgcagagggtttcaagggttaagtgcagcagactggtcaagtaaaataaagactttgtccgttgcatttaggaaaaggcagttgtggtgacctaactgagacttcagtgcaagagtggagtaattttcaggaatgactgagagatccaaaagtgagtccaggaagtgtagacagctctttccaggggattgaatgtgaaaggtggaaaaccgactgcaactagaagcaaagaatgaagaagacctttcacattgcttaattgtcactatttggattttcttacagatgattatgctcttaactaatgagacactttgatgtttagacaatgatgataaaacaaaacagtacctcattttaattgttgttgtccacaaaactgctcactaaattatggcaaagcaactagaacatgttttacagatacaaatctaaaaagtcagtaaatgagaatctgttgttggtagaaattttctgcataatttacaaagagggaaattataggcagaataatgttttgaaatgcaaaacatctgactcatagtagagatgaagagcagtgaatgacccatgagagaaacttatcttattgttcacacacagggtagagaaaattcaaaccgataaggcatcaggcaaagcaaaactgctttaacgaaggtgagtcataatgccactcagggagatgaatcaggtgcccacatgtccaatcactttcataattacagctccctacatcttttaaattaaaactgaagtcaggtaacaactaatgtccctttagaacaaacttagccaaatggaaatagacagagtcctaagaagtaaaatgagcatatcaaagagatgcagcttttctggaaaggaaaaaaagaaagaggggcagtggctcacacgtgtaatcccagcactttgggaggccaaggtgggtagatcacttgaggccaggaattcgagaccagtcaacatggcaaaaccctgtctctaccaaaaagacaaaaattagccgttcatagtggcacatgcctgtagtcccagctgctccagaggctgaggcacaagaatcacttgaacttgggagatggagtttgcagtgacctgagatcataccactgcactccagcctgggttgcagagtgggactctgtattaaaaaaaaaaaaaaaaaaaaagagagagagagagagagcttgcacaaaagcaagccatccctttaagtgtaatgtcatgactgctggccccaaaagacttttaaatgcttttattgtgccctctgttccaactgattttgataccttcccatcatggaatcactacagtagtttttgctcaacatgaagtcttagatatattatacctgaggcccctaaggtttcctgctcaagccaggagagtaagcagcctccctgccccctcccacccacttcccttctagctttcacagtcaatcaaaagcctagtaaattctacatcttagacatctaccctctgtcctttcccagagatacagcctgatctaagctgctactgacttacctgtaacaactagtttcactcatcctggttgcctcctttaggcaaagctacagcacagctagcgtgaacatggaaacatacaaatcagatatcattctgttgcctaaaccttagatggtttcccgccaagaccaacacaagcttatatgagcctctgtgagaattttgaaaaaaaggtaattgcccctactatgggataagcagaaaagagccacatttcagacccgatttaccctgtggttaggcttatttatgtggcgatgaaaatgcagcagacgttgcctgtagaataaaatccagactctttaaaatggcttatgaagccctctacaacctggcccctgccaatctctgcagtcacctctcaccattctttgatcttgctcttacagatcagtttcagttccttgaccatatcatgttctcacttatatctttgccaaacctgccactgtttggaatagtcttccctcctttgtgaccacataattcctgctcacttttcaggttttgacaaaaatattacctccctttacaggtcttccccgatgcccttgattaaaaatgctttcttgccatacactcccccagatcacctaaatgtgtccttgcataacagtcattaggattcattgaaattgctggcataggctgagtgcagtgcgcatgcctgtaatgccagcactttgggaggctgaggcaagtaaatcacttgagcccaggagttcaagaccagcctaggcaatgtggtgaaaccccatctctacaaaaaaaaaaaaaaaaaagaaaagaaaagaagtaactgggcatggtgttgcatgcctgtagtctcagctactcaagaggctgaagctggggggttacttgcgcctggaagtgtaggctgcagtgagctgtaatcgtgccactgaattccagcctgggcaacacagtgagaccctgtctcaaaataagagagaaattgctggtataacgtcaacattttctaatgaactctcagctcaaagagagcagagattttgtctgtttgctccccactgtattatctgtatatagtaatgtgtctgatgcttagaagctcaagaaatatttattgactgaataaataattacatgaataaaaaagcctggaatccttgttacagtatagtgggaagaggtctagtccaggctcttccactaacttattggttctgtgactgtaaacaagtttcctaaccacggtgagcctactctttaaatgtaatctttaaaatgttgacaataccgtttgtcctatctaccatcaaaattgtcatgaggctcaatgaagctgaggacaactaatgtgtactgacagcctaccacgtgcaaagctttatgctaggtactgccatctgtattatcttgaaaaatagaagaatctctgaaagactgtcatttacccaaagatcatttttcatagtaagtggcaaactaaagacttaagtaggaatttctgtgattccaaaggctcttttcttctcgtcccttcccttcctttccctgccctgccctgccttcccctcctctccctcccctcccctcctctcctctctttctccttcctcaccatgttccatcaatatctatctgattaatacttcaagtcacaggacaagcatcactcgttttgtgaaaccatctctgattcttctgaccagatttatgtgctcctataactatgttcatattgtacttactataataacattagttttaaatttttttttaccacaaagtttttgtgagaggggagcatgtcttcccactattatattatttccagtatcttgcctggatattaacattttataagtactaaaggaatatttgttaaatgaatgaatgaacttactttctctggcttttttagaaaatttgataatacacctaatttttgttcagtgtttacagttttatatttaatttataaacagcaataattgaggccccaaccacagtagctcatatgcttaaagttgttaagatagtattatgaacatacgacatcagctcttgcccaataatagacgtttggttttagattaatatatttaagattaatcttaaagtgcaactaataggctgagtgtagtggctcacgcctgtaatcgcaccactttgggaggccgaggcgggtggatcatttgaagtcaggagttcgagaccagcctggccaacatggcaaaaccccatctctactaaaaatacaaaaatcagctgggcgtgctggcacgtgcctgtagtcccagctactcaggaggctgaggcacaagaattgcttgaacctgggaggtggaggctgcagtgagctaggattgtgccactgcactccagcctgggcaacagagcgaggctgtgtcaaaagtaataataataataattttaaaagtacaaataattattgcctgaaagggaatatgctaaatatgagatacagggaaatgattcaggttcacttcaaatttaatattccagttttaatttgatataaggcaacctcagggaacaaacatgttgttagtagcaaactacttagcttagagaacttaacatagtatttattgtaatgttcccctgttctagaaaatcataactaataatagaaataaaacccagctgcatatcaatggccaagaacatatcaatggactagaaaatatgctaaggagactaaaacagacctgaacatttccttcaaatttaaataaagtaagtactttttacttattactaagatctgaaagatatattaaaaatactttgaaattacgtaacatgtgatctaaattgttcatctaaaacaacagcttgtcaaaatgctaatcactaggaaccgagaggtttgtttagttaatagtgcttcctttcacatgtgcttatgtgcttttcagaaggaaatctgaaatctattattagctttccatagtcaactcctgattatccgagttaataaaatagaacccagacatctgtgctaatagagagaacacagacatacaatagacctgattcagatccaaaaaagcagataacacaaaaattacatctttgactccggaataaatgttgattctttgtagcatatgtgccttcctaataacactccattagtttttctactatagcacaggggaactatgctacggaaaactcacctacacatgtaagtgagagttcactctagattgtgtgaacgcattgttagatgttagaattctgtcagtggtattcattccgcacactggattctgatcatcactaatatgttgaaaggtctcattctcttcaatgctccaggccctaatacaagattcccaacctcataaatggctcctgtagaaagtaacaacatcagggtgaagaaaaagtcagttatgggaaagaaaaaaaaaagccatgctatgctttgttttgacctcgtgaaagaacagggatcactcaagtttttactgttattttcaaagtcaagccttagatacttgttcactaaaggggaagaaaattataaattattgtacattattagatacatggctttctagagtgaaattaatgattttggaaatgctgggccaattactttataaatgtctaagaaaaatgaatatcttcctcatgtaaataactgcaatcttttcatctgtaaaatcagatcagttatgtaacaaaaacttacattaaaaatgacatatctccctgaggcaacttatgaaataacgaatgaaaggtaggctcatgcttccgaagaaagcaatgtagttcagaaaaaactacagagctcaccttactatatacatagcaataggcacataggtggcagaatcccagcaaagcaaatattctttcagtgattcaataatttgccatttattgagcacctattataaggtcagtcatcatgctggacactgtggatacactttatttgagacatggtccctgcatttaaggagctcacagacatgtaaataattttgtgtaagagatgcaatagtcgaagcatgtgaagaacgctagggggagtatggatgcaagaattggtgggagttaaagaaggcttcacaaaggaggttactggcatagacataatgtttgtaccctcccaaaattcatatgtttaaatactaactcccaaggtgatgggattaggagtggggcacttgggaggtgattaggtcatgaggacagagccctcatgaaggcgattagtgcccttattaaagaagcctggccgggcgcggtggctcacgcctgtaatcccagcactttgggaggccgaggtgggtggatcacaaggtcaggagatggagaccatcctggccaacatggtgaaagcccatctttactaaaatacaaaaaattagccaagtgtggtggtgcgtgcctgtagtcccagctactcgggaggctgaggcagggttgttgcttgaaccccggaggcggagattgcggccactccggcctgggcgacagagtgagactctgtctcaaaaaaaaaagaagaagaagaagaagaagcccaagggagctcctttgccctgtccactgtgtgagaacacagagaaaatgctccgtctatgaaccagaaagtgggctctcaccagaaccaaatctgctggtgcctcggtgtggcctccccagcttctggaactcaggaaagttaatttctgtggtttgtaagttacccagtttacggtattttgttataacagcccgaatgaactaaaagagttgtctttagccacagttcatgtaagaattgtaatttaccaagtagattagatgccaaggcattccaagatgatgaaaaagtacttaaaacaaggagccatgaactctaagaacaacatacttagaagtccatgatatatttggatagaggtgaacaggaagttatatccaaattatcaaggactgtgttgagcatgctaagacatttggatattcttatataaaagttattaagcagggacaaagcataagatgttcttaaacagcggaatggcatgatcagatatcctttttaaaaaaataaaaataaaaaaagaactctgttagctttaagagactgtcaagtcctggaggtgggaagcctaaatgagagacatcaatagtttatttaggtctggatgatccctaatatagtctcccaccctctgtcttatgtcttaagatttcattatcagagctttagctttataatttagtacctattaaagtaaaaattggtattttgggaatgataggatagaaaattgcataagtggttaagttgagcttggggatgtggggcaaaggtgacagttttaaaatccttccctctttattgtgtaatctcaaaaagatcaagggactggtattgatgggagaggcaccttgaggccagagcagatggagagagggacagacactctctttccaaaatcagaggagcatgggatatgtttgttttctgcctctccataatatggcacaacgaacttagtggcttacaagagcatgcatttattatctcacagtttacaagagtcaggagtctgggtggcttaactgggccctctgctcagggtctcatttagatattggccagggctccagctctcatctgagggccagggtccttttctaagctcacagactgttggcccaatttgcttccttgcagctgcagagctcatgtggtttattctccaaagctagcaacaaagagagagaaattcagctgcatcaagttgctaacttctatgcccgaaatttaaggaatcagcttattatcagttcatctctcttttgattaacttaaaaccagtgattggagaccttaattacatctgcacaatccattcacctttgccctaaaacatctgggagttatatcctatcacctttgccattggctagtagcaagttatgggcctcacacacactcaaaagaaggacctcacacaaaggcctggagacagggagcaggatcacagccttcttagaatcctgccaatgacagatttgaagagttgaggtcactagagtctaggagaggcaaggaacaatcagtctatccagtaggtagaagtaactggggagaatgtctggaacaagttctgttacaggctggctcactgtggcatgacacctaaaagtgaagcctgcgtttgaagggcctggccccaggtaaacacatgaggcacccacccaacatagacaagtgcagagagcaagaggggaagatgttctccccaaagaagactgtacagatagaagatctgaatagagaaaaaggacttgtagtttgaaaactgttttcaactagggggaaggaggggattttctccatagcaccaacctgggaataccaaaagactcttttcctccttttgttttaatttttcaattaccgtaagcttttctctcacagctttatttttaactttaatgatcacacatatatcacacaaatataactaatacgcagggagatttttcaagagatataaacatcctggttgagaaagtcaggagagaaaaactactaagtaaactaaaaatgacaagataattagagagaagatatatacagcaataaatttgaatttcaaagaaaatttcaggtaacaaatctgttatattttcacgtgcattaatagaagttaaagcaagagaaaattgagttaataaaaaattgatttaaaaaaaaacagattttcaacacaaaatctctctgaaactactgcgcccttgcctctgctgtaattttggaaggattagcgcttgtaggactctggctgtccccagcagtgacacaccttcccaccccaggatacataaaactggggcacagagcagatggaattttcagctctgctcatcagcaggttgacctgcttgttccaagcaattttgtgaatttaagactctggtgcctggctggactcatagcacccgggtgctctgcaatttgtacagaattctaaaatttcaggctctgcttgttgcctagatctttagtaataacagcaataaaaaagtaataatacccacatgtattaagcatttatgaagctacattaattaagcatatgttgtgtttatgtagtttgcagttaatggcactggcttaatgtaatagggatagtattttttaaagaagaacttgatatatttccatcttcaaattgtgtttcactggaaactgctcctcttccagggctggacagggtacctaatgccctcacggaagaaaaggtgggttagcaagtcaatagacttaaaaatcagagtcctgctttagaccaatcagaatgacgtatgaagatctattgtatagacaaatgagaagcccatcccagaagagaaaggacataccagcttctggagaatttcaaaacggaaaaggctgaatgagatggggaggatagggaaatagttctacatttgtgtctggaactttcctttctgggcactggcctcgagagaatgtagcataataaataggtattgggcaaacataagaaaagagagctctgggttcccaatcccatctagattctgggcagggccacatcccattaaacttgatagttccctgtggtaaggactagcaagattttggggataaatctttctgagtcccactgatattcctaaattacgaatgagacccagaggtacctggagcctccagaagggggcctcagcaggcagctggtctgaaagccaactggactgccctggggccagcttggcaaggggagaggtgaccgctgcagaggctaggaaagacagatggccgacctggcagagactcagagggaccactttgccagtgcgaggcgagctgaggtgaccagccagaaagagctccaggctctggccagaatggtcttgacctaaatatgccacctgcaggccacaggtatactggaagggatgcccactccctattatcccttttcctgtgtgtctctccggccccatgtaccagccattcattcgttaggagtttgaacaaaaagctaattcaaactttctccatcctcctcaaatatctcatctttgccctcttttgttactctccaaagacagccttgctcttggttcacagagaaaataagagccaccggacagtaaaatgcaaatcagatcatctctcttcgtttaaaacacctatcaatgacttctcattgctcttaggataaataccaaaatcctgaaggtagctacaagggtttgattgggcttttactcgctttgcagcttcaactgctgtcatttctctcctttctctctgacctgcagtttcatgttaatttctaccacagggatttttttaaatatgctattccttctttaaagaataatcttccttccccaccttggcctacttaattcttctttgtctttcagagccccactcattgttggcatgagatcagtcacccccttgagatactctcacagcactttctcatggcacaccctgagtaaacatatttatttaatattgcttaggtaagccaatagtattatatcaactaatttcatttggagtagcaagtcccatgcactagctaactaacatcaccccattatctaactatatattttcataattttaagtgctgaaaagcaatcaacttttcttcatcaagcatctcgtaacctgtaccttgccttctacctgatgtgcaatttgtcacaaaggcactgggtgaaagtcatcatgtgacaccacaggaaaacaggaaaaagtacaggagacacatttcatgatttatcaagaagtgacaagaatataatttaccattacatctatatgcagcatttgatataaaaatacttgcctctagggtacctaaaatcctggtctattgaaagtactgaacttaccaaccaataactcagctaatatatttaatgtatatatttttaggaaaacaggtcccaaagatgtaatctcgcatcatcctctctaaccctttactttctccatatcagcttgccccgaatcttagcttggagttgagaggtcatctcagcagcctgttcctggccttcctgtcggctggaggccaaagcctccctcagctgcctgtgtccagtggctgctgtaataatgatgtctcagcttcaggaggtctatttccaggccatgtgagctaattaaaacacaggccttcatttgcctttctggcaatccctgatcagtgtgagaggcctatgccaccctctccattctaattttagttctcctctagtgttttctctcctttgcagaaaagcgtcctatgctgctaagcacttacaggcttttgtttttgttatttctcccacttggaaagaagcacttttccactttactccttttgggttttctcctcccatcagttttctcctgcaggaggtgatggtttgaaactactagcaaaactgaagataattagttacccaaggtagttgacttgcttagcaggtgcccttgagaaagtgctaatgcacaaaattcttcatgtggaaacaactttttggacacagctttctataaagatagagaacacctgttatcactggcgatgctcagcttcttttcccccagcaattcacaacacaactatccagagttcagaactcataaattcactcacaataggctgagatgctatttttcggtcttttaaaacggatactctttacttctgataagcataaaattatcacatggcttcctcccaccctaccctccctcactgaaaaaaaatcattatctcaactatctactctacatatctacttgaatatccaacagattttcaaattaaaatgttcaaaactgagatttccccatctccactaatatcagctccatctttccaaaggtcaaaacaccaaatatctttgaattacaactttggtcccttttattttcttatatcctacctccaattcatccaaatatatatgtagatagattgatagatcaatcgatagacagatgatagatagatagatagatagatagatagatagacagatagatctacctttaacatagatccagaattctaccactcctcaccacctctatttaaaaaaaactgttacccgaggaaagaagaacacactggcaaccattaaggggacccaagagattgaaatatcttagcagatgggttctcaggtcattcaaaggtttcacatgagaatgagacacatagtggccatgtgcagagagagccccttagggaagtggccttgaatgaaacacctctcttagggagactttggcagccagggaatgacatgaggagccttggcacctcaaggaagagtgggacaaagtatagaagaagtgaactcagataaaggtgatctatattacaatgtgttaaacaaatggaaagattaaatattatgaacgcagtgaatgttatgtctttagaagtatcaaacatttcttccaggaaattgttgtactgatttaattgcagtatttaagaatatgttgatggaggagaggctaactcagctgctcagtcccatggtcttaagacaattgctgataattataatcattcctagttccttgtgcatcccattctttgaatccaacaattattccaaccctcttctttaataccttgactccagcaatactttgaccccactggaatctccagtcctaagatcttattgatttttcagtgttaattatctccttgttctctttcacttccctcttcatcttgaagtctatggttaaatattacactcccttgcatttatatttccttgctcttcaatcacttcaatataccaatttagcaaaaccacaacctatgtaaaattcaactctccaaatactctgcacctgcatcctccagctgacataggctggagaaaaacacagaaccacattggatagtctaattctaaatgcatgaacacagactttaaataggcctttaatgctgccaggtgatcacatcatatacctcctttgtccactcactgtttcttctaaacaactatttcacactgttctctctttcctcaaactctacatttccttctctgtctttggtttcaattgaagctgctgctctctactttgtagaaaaactgaaaactatcagaacagatcttccccagattcccaccacatggatctcctgccagtatttgcacccacaaccaaaacatctgttcatgctcctgtccaaaaccagtctctccacttggttaataatagaattcatcatcccctctttctcctccatcgtaacttaaaaattcccctgtgaagaaattccttcaagggtagtctatcattactctaagtcctctcctccctttctcccttaaaaccaccacatgaggctctatcatttccaaccaaattgctcttgtcaaggtcagcagtgacccccccacccccaatattgttaaatccatgaacctattctaacttagtcctcatcctacttaacttatcagctatatttgacagagttgatccctctttccttcttaataactttcttcacctgacttcagaacaagacactcaccaaaagatttccttctatctcacaggttgctccttatcagcttcccttgctggtgctgcctttcattccatccttcctcaagctcagttattggtcttcttcctctacacacgctgcatatcatctgtataatgacgacgttcacatctatacctgcagactggaccttctgctgcctacttgacacatctattcagatattcagtaggcatctcaaaattaactcctggtatttctcactgtttaccaaaccttctcttccccaaatctcttgtgtgtcaaacgataggaaattcattcttacagttgttaaggagaaaggtcttggagtcatccttaattcttctcattttctcatataccatgtccactccaccatgaaattccattggatctgccttaaaaatatgtccaacatctctccatttctctctaactctgctgattcacctgtgatcttagctgctttccctctcttactgcaatgctacaattgccttctaactggctttcctgcatccacccttgttccctctccccatccatgatcgacattatagccagattaatcctcataaaatagaagttagatcatgtgacttttcttctgaaagaactgaataggctctaagaaaaatcactctgggttaaagccaaagtcctgaaatggcttattagggccttacataatctatccctcaccctctcttcttacctacaaatattctacatttcaaggaagagcatccacctttcactcatcagcttaagctagaaactttagagccctccttgaaatatttcccctcatctttgcacatccaattaccatgacctgttaattactctttccttgtatctcttaaaccaatttacattttccctttgctatgaaactatttctccccttctccaatgtcatttcatctcaaatctactacatattaatactagagtgaactttctagttaaatgtgaacctatttatatcattccccagactgtataacaccaaagctttttaattctaacaaccttttttgatgattcacaagttgaagctttaatcacaattcaagctactttttaaatggccctctgttataataaattcattggttcacttaaaagtgttttgcagcatacgatttatttttgaagatgtattagtctttgttctgttaaatgccattttggtcaagattaattttttgtgtatgcaatcatttataaaatgaaatgtagattaatcagtaaatttaaattatacttctaagtcaagaaaaggtcagctatctcggcataagcttggtcagctaccttggcataccttgtacagacttacaacaggcccccctatcttaaagctactacagatttcaaataatagtattaaaaacaaaaataatattaagcaataactgtgataatattaaagaataatattagttgccaaggtttacaaaatgtattaacataaactcatttattactacaaatacctaaagagtagatattatttccactttcagaggagcaaattaaatgtcagaaaagttaaaggttttgatggaaaatatctagcaaatcagtgatggaactgactcttcaactcattctctttatatacccagtggcaatgtctgtaaagcataacaaattaaatatgtgtaagctaataaaatgctacttttgcaagtacaaatgccttccttacaagttttcctttttaatgtaaagcaaagcaaattgtgctttcacattattactaaatatcagtctatcctaaaattgtttatgtaatgtggaggtgatatattatcttagaaaaccactgtaacatggtattggaaaccatttcaactgttaaaaggttagatttcagttctgtttaaaggtcagacctgaaaatatcctgatgattacaatttctccacacattttggatgatgccactgaactcctggcagcagcaaaatgtgtttgttctgatcctctgcttctggtggtcagtttcagagtggagaaaaggcgccagggctttgggactagacctaaatttctattgcttttaattaaaataataaaggggaaaaggtaatattcctatccaactgagacagaaaaatttgttgaaaaccgattcttacctgttgaaaaatattcagaaaatcgatcatccccaaaacaatgtactaactaaaacaaaaccaagaaaggcattctgaaaggcaagtatcaaagcatctgtcattgccccattttaggttttcaaatctggaactagtcattcaaataaatattgtttgaataataattatatgcccagaacccttcccaggtccacataccactattttttgtttttacaaatcacatctcatctctcctgtcctataaaactgcatttagtacatagcagacaatacattttaatgctcactgaatgaatgctaggattgatgtagaatacaaagaattatgttaatatcattgttattgctactactactaatagttactaacatttattgagcactaactatctgccaggcactgtgttagtcactttacatgcatcaccacagtacagggtaagttaatctaattaattcattgttaatctaattctatagtaagaaaactatagcataaagagatcaagtctcatagctaggtaagaggctcagtttcacagttagtaatcaaactttggcagtctgacctcagtgcttacaatgggccagagaccaacctattgcagcttacattctagaaagacgacaagaaataagtaaagaagtaaccaatataattttacataggagataaggctatggataaaagaaaacgggatgatttgatagaagtgactagagtgatatagaaaaatggttaaaaacatgaactctagtaccaggtttgagttcataccagaactttttccagctttgtcattatgggctgttatttagttacttatgttctttgtgtatttccttatctacagataataccgaatttatataacagtcatgaggtttaaatgaattgatatacataaaatgcctaaaacagttcctgacacatagtgtcatttaagtatttattattattgttatttttgcatttttattgttataattcttatcacgttgaggacatctacttgagatagggtggtatgggaaggcctctatgaggaaatgcatttgaaccaaaacctaaatgacacttaggcacatgaaaattttaaggcagagattccaggcagaaggaaacaaagtgcaaaagccccagggctagaatgttcagcaaagaaagccagtatggccaggatgagttcagtcaagttacagagctagtcaggaaccaggctaaattaggcatcactggatatggtaaggagttgggttttattctaagtgcgattagaagacatgggaacattttaagcatggtaatgacatgctttgatttacattttataaatatcactccggcttccatgaaagtttggattataacttccatagaatgtcaatcttatcattcccattagtcattgtttttaaaatcttagctttattcctagggaaaagtaattctctgactatatttccagaatgtttgtgttagtgcttttaaacatagagtccgattaaaggacttaagtaggtatatgaacatacatatatacacatacactcactgtgaacaaagattatatggaatactcacatagaccacacttcattattctaaattcaaatcagaatttgaattcactgaatgaatgctaggctgggtttttgaatcatgtttcttggaaggaaagtaattgtttacttacatgaaagttgaccatatgaattaggtcattcttgttatacccaactaaaacagttgagaggtcaaggggagaaaacatctagggcacataacactgttccaacaatgtaattccctgtgagcttggctgctgaagctgcctgctgtaacctgaaaccagttttatctaatagctactgaaacaacctgctgcaactctgagaatcattttacccatagccatcacttaccaatcaaaactttccagctcaccaacatattattagtgccaatgaacttcctcaaagagcaatatgtaactttccccttttttgtaaaacctctatccgtctgttctctggacataatgaagaccatccagcctatgagtatgccacaaatgcaattcttgatttccaaataaaacatttaaaattaagacttttgtctctatattgtatttgtctttaacccttattgtaaattatatggcaggggaggatattctttgggtcccacttctcttatttctaatatgtcccttggccttgccaggcgttagctccttgtcccccaaataaagaaagctttgcaaatctgactgcatggaacaatgtatgttttactagtgggtggtgttatttttcttaatcttaccctcacacccagcattttctcccccaacacacttcctctgcaagttcaccatggtttaaataggttgaaagccagcctaggccacattgtacaattccttcttaccagacatccttgatataagttctccggcttcaaagcatctcttaataaagttgtctgttgattagttgataccgctgtgtggtgaggggtaaatggcagtggaagaacatttccaggtccctggtatttttactactataatcacattaaatcatcatctttaatatctaacaccaaaaggccatccatgtattcaaaaagaatattacagccacactgacaagaatcttaaagccctacattgccacacatggaggtgaactaaaaacacaatgcaatttgtacgaagactcctcctaattcctctaactcataaatacttcagtcttaaaataaaaatacagctgcataaagtgaactgctttacctgtatggttagttccctcattcttgacttctgtggttcccacagaagaggtgggtggactagcaggaggactggcagtaaagcttgtgcaccctgtagatgtgttgatttcaaaatattcttggttgtgattcattcggtgaaaatccagagaagacacaatggatgttcgctgtttaggctaaaataaatgagcatgacgagagtattaatatgatcatgttcatcttcagcccaatctccccatcaatttaatctaagtgataatttttttcagttaaaaactatctgggttttatacttaaaatataattgtgctttacagagatacattaatttcttgatgaattaaataataaaaaattatttaatgagaaaatattatggcatagttgatgtgataggttaggcttttcatttgctttccccagaagattgtaaaaatatagtgcacaaaatttctcttggtaatcaattttgaaagttgcaattttaagtcacctttcattcaactaacatttattaagcatctggcatttgccagacccagaggatatagaatctaataataaaagggccttacaacatagaagaataattaaggcagttccatttttttattctttaaatagtccaaggaattggtggcattagatattgttcccaagtacaagatgctggaattttatcatcagaattaaataaagttatatggaacattttctaagatctaagaatatgcttggtatttttagtgaactttgattttcttttttaagaattttaattaatccccaaatagcaagaaaagtcaatttaaacataaaagttaaaatcatggagtaatagcagatataatctataccctttgtcagtaatgaattactccccgtagcaattttctggggctttttccccatagttttaattatattcactttcttttcttgcctagcagagcttctaacattgtccttcagaaaaactgcagttttttggctctcaaatgtgtgtgtttttcccaggattcaactctacctttcttactttttattttttagtttatattactgaaatactaaaaatctcttataataattataagagatcaaatgtaaactttttataataaggtaaagtttattgtactttactttctccaaagtacaattaacttttggtttactaatgtttttattacccttaaatatgtgttaatccctgtactccatagattattttcctgcaaaatattcaaattgctgtctcttccagcttatcattttcttccaagtagatatcatttaatctataatctaaaatagacaatcatatggaaaatatctgcacagtatagggtttttaaaaaaatatataaggtgtgtaaattatcacaatatgatttattctttcaccaatatttcaccaaatatttttatgaaagacattgagaggtataaatattgttatgcaagagagtgcaagtcatttattattatgacacatcaactcagtaatagaattcaaattagcacccacagaggactcagttgcttttgaaatacaaaagatcagggtttaatgtcaggcttggtttctcatgaaatgtctgtccttgggactgctgaatctcaatttcacattcaatgtcctttccaccacattctataatagcaattagaaaggcatgagctatagcgctggctccaatggagcccatcattctaggctttgttttattgtgttgtgtttttgtttcactttatgtgtaggcaatggaccacatttctatgtttcttctcataaattttataaaggtcaagccaaatgatatatatgattcccccatttctaattgtttcttaaatacatgtttctgaatcctgaccacccatggttctaactgctttaaaaacacaatgttttatgcaatcatgaaaacaaacaagctattttgtgcaatattaattcattctacaaatatttgctgaacatacactaaactgcagatatcatgcacgtaagcactgtgataggaataaaacaagacactgtccctgttttctgtatgaatataaacgaggtgggaggatggatggcacatgagtcttcgaaaaagagacaagcaatccaatgattatgcttcagtatcacatagcagtaagggtgatgaaaaattagaagcattatacttagtcatgccctaaggcaagggtcagcaaactatggcctgtggctcaaatctggctttcttcctgtttctaaaaatgaagttttattggaacaaaactgcacccattgctccctcatttagttatggtctatgactgccctcgtactataattgcagagttcagtagtcgcaacacaggtcatattttccacaacacttgaaatatttattatgtctggctttttagagaaaatatttggccactcctgttctatggaattgtttcacacctcaattttgtgctcaataaaaccgtaactataggtttccttttatttcctagcctgacttgcctttgggttgggcaatgtgactaattctcatcaaatacaatattagtagaagtgacatttttctatccctctcttactctcctaatgatgtagttgaaagatgaaggaaagtcatgaaactcactaattagttttatgagatgttaaagtgaaccttccttttttatatttttattttaagttcaggggtacatgtgcaggtttgttacataggtaaaggtgtgtcatgggggtttgtttaacagattattttatcgcccaggtattaagcctagtactcattagttatttttcctgatcctctccctcctcccaccctccaccatctgataggccccagtgtgtgttgttcccctctatgtgtccatgtgttctcatcatttagttcccagtgatgagtgagaacatgtggtatttgattttctgctcctgcattagttcactcaggataacagcctccagctccatccatgtccctgcaaaggacatgatctcattcttttttatggctgcatagtattccgtggtgtatatataccacattttctttatccagtctatcattggtgagcattgaggttgattccatgtctttcatattgtgaatagtgctgcaatgaacatacgcatgacgtgtctttgtaatagaatgatttatgttcttttgggtatatacgcagtaatgggattactggatcgaatggtatttctgactttaagtctttgaggaatcactgcattctcttccacaatggttgaactaatgtatactcccacctgtagtgtataagtgtggctttttctccacaaccttcccagcatgtgttattttttgactttttaataatagccattctgaattgatttgaaatggtatctcattgtggttttggtttgaattactctaatgatcaatgatgtagcactttttttcatataattgttagctgcatgtatgtcttcttttgagcagcagtgtctgttcacttttctttcttttttttttttttttttttttttttgagacggagtctctatcacccaggctggagtgcagtggcatgatcccagctcaatgcaacctctgcctcctgggttcaagtgattcttgtgcctcagggcctcgagtagctgggattacaggcaagcattaccatgtctggctaatttctgtctttttagtagagacggggttttgccgtgttggtcaggctggtcttgaactcctggcctcaagtgatctgcccacctcatcctcccaaagtgctgggattacaggcgtgaacgaccatacccagcccccaatgcccactttttaatgggggttgatttttttttcttgtaaatgtaagttaatttcttatagatgctggatattagcctttgtcaggtgaatagtttgcaaaaattttctccccttctgtgggttgtctgtttactctgttgacagtttcttttgctgtacagaggctctttagttttactagatttcatttgtcaattttttcttttattccaactgaaggaacacttatacactgttgatgggagtttaaattagttcaaccatgaagacactatggtgattcatcaaacagaaattttgaggatatttctgttcctaaaaacaaaaatataccatttgacccagcaatctaattactgggtatatacccaaaggaatataaatcattctgtcataaagacacatacacacatatgttcactgcagcactattcacaacggcaaagacatggaatcaatctaaatgcccatcagtgatagactggataaagaaaatgtgggatataatatatagcatggaatactatgcagccataaaaaagaattagatcatgtccttttcaggaacatggttggagaccgaggctattatccttagcaaactaacacaagaacagaaaaccaaatattgcatgttctcacttatatgtgggagctaaattataactaatggacacatagagaagaacaacacatactgggcctattggagagtggagggtaggaggaaggagagcatcaggaaaaataactaatgggtactaggcttaatgcctgggtgacaaaataatctgtacaacaaaccccatgatactattttacctatgtaacctgcacatgtactcctgaactcaaaatagaagttacataaaaaatttaaaaaaagaaatgagaacaaagaagctgctttgaggaaactcaacaaaattcaagataacgcagatgaggtattcagaatcctatcagataaatttaacaaagagattgaaattattgaaaagaatcaagcagaaattctggagctgaaaaatgcaactggtatactgaagaatgcattagaatctgttaaaagcagaattgatcaggcagaagaaagaattagtgagcttcaaaacaggctatttgtaaatatatagtcagagaagacaaaagaaaaaagaataaaaaagaatgaatcatggcttcaagatctagaaaatagcttccaaagggcaaatctaacagttattggccttatagaggagggagagaggtgggtggaataaaaagtttactcaaagtgagaacagagaacttcctagacctaaagaaagatctcaatattcaagtataagaaggccatagaataccaaggagatttaatccaaacaagactacctcaagctatttaataacttaactctcaaaattcaaggataaacaaaggattataaatgcagcaagagaaaagaagcaaataacgtacaatgaagctccaatatgcttggcagcagatttctcagtagaaactttacatgccaggaaagagtggcatgacatatttaaagtgctggaggaaaaaatgtttatcctagaatagtatatccagtgaaaatatccttcaaacatgaaggagaaataaagactttcccagacaaacaaaagttgagaaatttcttcaacattagatctttcctacaataaatgctaaagggagttcttcagtgtgaaagaaaatgacgttaatgagcaacaagaaatcatctgaaggtacataactcatgagtaaaaaaaacacagaatagtataacactgtaattgggatgtgtgaactcatattttgaggtgacaaatgaaaaaatagactgataataacaagtatgaaaacttttcaagacatagacagtacaataagacataaatagaaacaacaaaagttaaaaagtagggggacaaagttaatggctacaatatttattagtttttcctttgcttgtttgtttatgtaatcagtgttaagttgccatcagtttaaaataatggattataaaaaattatttgcaagccttaaggtaaattcaaattaaaaatcctacaatagatacataagaaataaaacaagaaattaaaacataccagcagagaaaatcttcactaaaaggaagagagggaggaaggagagaaggaggagatcacacaaaaaactagaaaacaaataacacaatggcaggataagtgcttatcattaatatcaataatattgaataattagactagaatctccagtcaaaagacagagagtagctgaatgggttaaaaaaaaaagacccaacaatctattgcctgcaagaaatacacttcacctataaagatacacatagactgaaaataaggggatggacaaagatattccatgcaaataaaaatcaaaaaagagcagtcgtagctatactgatatgacaaaatagatttcaagaaaaaactataaaaacagacaaaaaatcattacataatgataaagggtgaaaatcaagaagatgatatcataatttcaaatatatacgcacccagatatataaagcaaatattattaagggtaaagagagacataaaccccaatacaatagtagctgaagacttcaacaacccactttcatcattggacagatcattcagacagaaaatcaacaaagaaatgtcagacttaatctgtactataggtcaaatgggcttaataggtatctacagaacatttcaatgaacagttacagaatatacattcttctccttagtacatgaataattctcaaagatagaccatttgttaggtcacgaaacaagtcttaaaaaaactaaaaaataaattgaaattatatcaagtatcttctttatccactataaaataaaactaggaatcaataacaagaggaattttggaaactatacaaacacgtgaaaattaaacaatatgctactgaatgaccaaatgggtcaatgaagaaattaagaggggaatttaaaaatgtcttgaagcaaatggtaatgaaaagacaacatagcaaaacctatgggctacagcaaaagcagaactaacaggaaaatttatagctataagcacctacatcaaaaaagtagaaaaacttcaaataacctaacaatgcatcctaagaacaagaaaggcaagagaaaaccatacccaaagttagaagaaaagaaataataaagatcagagcagaaatagataaaattgaaacaaagaaaataccataaatgctaaataaaataaaaagttggttttttgaaaagataaaattgacaaacctttagccagattaagaaaagagagataagcctcaagtaaataaaatgagagaagaaaaagacaacgttacaactgatgccacagaaattcaaaggatcattagaggctcctaggagcaagcagtagtctcccagcaaagaaaagcccaggatctgatggcttcactgctgaattctaccaaacatttaaagaataactaatacatgccttactcaaactatgccaagaaatggaggaggaggaaatacttctgaactcattctacaaggctggtattaccctgataccaaaaccggacaaagacacatcaaaaacagaaaactacgggccaatattcctgatgcatgttgatgcaaaaattctcaacaaaatactagcaaaccaaattcaacaccacattaaaaaggccattcattatgatgaaggggaatttatcccagggatgcaaggatggttcaacttatgtaaatcaatcagataatacaacataccagcaaaattaaggacaaaaaactacataactgatttaattgatgctgaaaaagaatttgataaaattcaacatcccttcatgataaaaacccactgggtatagaagaaacagacctcgaatagtaaaagccatgtacaacagacccacagtatcatacaaaatgggagaaaactgaaagcctttcctctaagacctggaacttgacaaggacgcccactttcagcactcttattcaccgtcatactggaagtcctggctagtaatcagacaagagaaagaaataaagggcatccaagttgaaaaggaagaatttgaattagcctttcaaaatcttacatattttgaaaaacctaaagattctaccaaaaaactattagaactgataaattcagtaaagttgcagaatacaaaatcaacatacaaaaaccagtagcatttctatatgccaacagtgaataatcagaaaaaatagaacaaagaagtctcatttacaatagctacaaataaaataaaatatctaggaataaacttaaccaaagaagtaaaagagctctacagtgaaaactataaacacggatgaaagacattgaaaatcatataagaaaatgaaaagatattccactttctggattggtagaataaacactgttaaaatatccatactacctaaagcaatctacagattcaatgcaatcattaacaaaatactaatgatattcttcacagaaatggaaaaaacaatcctaaaatgtatatggaaccaaaaaagacccagaagagaataagccatcatgagcaaaaagaataaaactggaggaatcacattgcctgacttcaagttatactaccaagctatagtaaccaaaacagcatggttctggcatagaagcagacaaatagaccaatggaacagaatggacaacccaggaacaaatctatacactgacagtgaattcatttttgacaaaggtgtcaagaacatacacaaggttacataagggaaaagacagggtggtggtggaaaaacaggatatccataagcagaagaacgaaagtagacccctatctcttgccttatacaaaaatcaaatcaaaatggattaaataattaaatctaagacctcaaactacaaaactactaaaagaaagcatcagggaagctctccaggacattggactaggcaaaaatttcttaaggaacacttcacaagcataggcaaccaaagcaaaagcggacaagtgagattatatcaagctaaaaacttctgcacagcaaaggaaacaaccaataaagtgaagagaccacctaaagaatgggagaaaatatttacaagctatccatctgacaagagattaatagccagaatatgtaaggagatcaaaaaactgaaaaggaaaaaaaatctaagaatctgatttaaaatgggcaaaagatcagaatagacatttctcaaaagaagacatacaaatggcgaaccgatatgagaaaaggtgttcaatattactgatcatatgagaaatgcaaattacaactacaaggaaatatcacctcaccccagttaaaatggcttttatccaaaagacaggcaacgacaaatgctggcaaggatgtagagaaaatgaaacccttgtaaactgctggtgggaatgtaaattactacaaccaatgtagagaaaaatggagattttggaggttccttaaataactagaaatagaactaccatatgatcctgcagtcacactgctaggtatattcccaaaagtatatcgaaaacatagctcattctctctcatgtttattgcaggactattcacaatagccaagatttagaagccacctaagtgtctatcaacatatgaatggataaagaaaatgtggtacataaacacaatggcatactattcggctataaaaaagaatgagatcctgtcatttgcaacaacatggatggaactggaagtcattacgttaagtgaaataagccaggcacagaaagacaaacattgcatgttctcatttatttgtaggaactagaaaaattaaaacaattgaactcacagtggtagagagtggagtgatggttaccagatgctaaaaatggtaatttgggtggtggggggagtgggaatagttaatgggctcaaaaatgtggttggaatgaataagatctagtatttgatagcacaatattatgactagagtcagcaataatttattgtaccttttaaaataactaaaaccgtataactgaattatgggtaatacaaagaaaggaaaaatgcttgagttgatgaacaccccatttaccccaaaatgattattacactgcatgcctgtgtcaaaatatctcatatactctacaaatatatatacctactatgtaccccaaaaaactaaaaattaaaataaaaaagagatatctatgtggagaaatggaataacagcaatgggagaaaagaataaagagatggtcataatattaaaatggagataaaaaagaataggtctagaatattcatttaaacatgtttgatttaatataatttttactactcaaatagaattgcactcagccattcagtataaaaaagaaaaagtgttttcacaaattcactgaaattacatattgaatttgccaagctttgatatgtagaatgaattgcacttgtgttcgttgtggcttctccactttaaaacatatccctccactgtggtccagtcctcatatcaccctactttccagaggacttgcttctatacatatttacttagcaggagtcagcaaactacatcttatgtgccaaagccaggcttctgaatatttttgttcagcctgaaagctaagaatggttttcacattttttatcgttttttagaaaaggaaaaataatattagtaacacatgaaaattgtatgaaactcaaacttcactgtttgaaaacaaagttttatggagacatagccatgtccattcattgatgtattgtctatggctgttttcctgctacagtagcagagtgtagtagttgtaacgtagaccttatgaacgaagacttaactattttactctctgatcttttataaaaaaaaaaaattgtgaccctttctataaagtgaataggaaatttcagctgggcacagtggttcacgcctgtaatcccagcactttgggaggccgaggtgggcggatcacgaggtcaggagatcgagaccatcccggctaacacggtgaaaccccgtctctactaaaaatacaaaaaattagccgggtgtggttgcaggctcctgtagtcccagctactcgggaggctgaggcaggagaatggcgtgaacctgggagggggagcttgcagggagccgagatcgggccactgcactccagcctgggcaacagggcaagactccatctcaaacaaacaaacaaaccaacaaacaaaagttaacaggaaatttctctgaggaggtaaagttgaacagacacaggaacgactgtgattgaatcagggaaccagtgcaacataaaaaggtaggaccccttgtttcaagagcaggtacaaaaacttttttctttttcccatgttctctctctagatctgttatggtgttcttttatttgctacttaacgtattgctcccttggtcatggaaacactcacagggtgagggcagattcttacaggaatgcagtggctctgccctgcaactcagtaagtgcatctgaccttgacccttccccacactcatggtctcactactgcatcagcagtttctgggcaggccaggggcacctgggttggaggagcaggtggaaaagaattttactcagtaaagaaagtagaaatagggtggaaagtgggaaaacagttaagtcaagattccaagccccaacacatgttcaattttcccataaaccgccttacaaaaccctgggccaggagcaccagggttgggggagctgctagagtccccagtgtctactgttcccatctttatgtctgtgtgtacccaatgtttaggtcccacttattagtaagaatgtgtggtatttggttttctgtttctgtgttaattcactcaggataacggtctctagctacattcatgctgctgccaaggacatgatttcattcttctttatggctgcatagtattccacagtgtatatgtaccacattttctttatccaatccactactgatgggcacttaggctgattccatgtcttctctatagtgaatagcaccgcaataaacatatgagtgcaggtgttttttggtagaaatatttattttcctttgggtctatatcaacctgggatattttgtgtgatacatatgacgaaaatatttaattctaaatatttttttctcaaaatgatagcctactgtcccaataccattatttatccactgatttgaaatgtcacctttatcatatactaaatttccaaatagagattgggcttgcatttttggactcgactatattcccattgatctatttgtctattcctgtactaacatcacactctcttacttactgtatggcttctatttctagagctcctagtgcgtggatattggatctctttgacccttcctgttttatatactgggagtattctacagttcattgtcctaaagaaccttcattaatttgctaggaaatacttattgaccattatcagctgtgtggtcaggcgctgttgtagcctctggggatacatcaatgaacaaataagataaggcacataattttaggcattttgttttaacttttggtgtgattatgctatttttaattttaaaaacttttcttttttttcaagtattccatttttaaaatagcctgttattaactttataagttcaatcacctctcaaatctttctgaggatactgattagagtctttttctggcattaagtcagttttcttaaaggttccttactttgttcattaagcctggtttctctctttttggttgttaatttttcctcaaccatctggtgtcttggtcaagcactttttatacctagggcactgtccccacattaggagcttcagggggtccttcaccttccttagatacttattaccatctggtgggcaaacaacaaagctgattgctccacataggagatgctaaggttctggttgccctgtccactccctggctttgataaccatgccctgttgctcaggcttgagattcttcgcagaggtctaatgaggatgtcaaatccactcattgttccagtgacatcttcccctcttccaccagtgttggatggtgggctttttcctcttgttttgtctaaatctagcaatatttgattttatcttttagaatttcgcaaatgcctcaggtagtaactctccctgtttttcatcactgctatgaatttattgttaattttgtatttatttttaccattttgattgcaagtaaggaggaggaaaatgtaaacacttgcgatccactcagctttatcagttagaattctcatatttctctgtcttgatcactttgaagactgtatataagagatttgaggaagtctggacaactcgaagaaagtaagtatcattgccatttcatcacagatgtcatgcaaatggaaaattattatattttcttgatttttcaataaatggaaaacaattttaagtgaagtacaattttttggttgttatgaatatgatgttaatgtgatcaagacttgctctaaagatgtagaactccttatcttcaggtaggcaaatgcaattcttctgctttatagattatggccaaacatagacaaaaaatatatgatcaccacaagggagttaaagaagtcgtgagtgagtattgagtatttaagagacgtggacattcttctaggcacttgaaatttgttgtctcattgaagcctataatgttagtatcaaaagtagctattactctttccattttatagacttgagattcacagataatctcagttaagtgggagagctgaaattaaagttaagtgggagagatgaaattaaaattaagcgggagagatgaaattaaaacacaaatctagtgaatttcaaattgattgcattttccccgaaagacaccacactataggtaaagcaaagagaagcaaacatatttacaagtaaagccaagagcctaataactcttgagtttctcatctttatatcaacgcacaattttcctactcttcagtctattggtagcattgatttttttaaaaatctacattgtttcaaaagctgttgaaataaaacgcaagtgggtggaaaatgggaataaatagtatctaattctgctatgcattaaactcttacagtcactacattttttataagagaaaggcagaaaatttttaaaaatctttatatctcctgactttagctcttcatttcatttttatatagaggtatctgactatgaaataatatgcatactcatcttctatttaaaaagacaaattataaaacagactgtagggactctgtactgcttctcagacactgcaatcccacataggagcaaggtcagatttactgatacaggcaactgtccaaagcagctcttctcctgctagctgttgatgttctcttcctctctgccagctccataacaagggccctcacccggtgcaccaccctcgcccacacacacaccctgaccgaggccctgagagttccaggttcctgcacctgcctttcctgcccagggctttttgagaacagacagttgctctcaagcccagggctttctgagagcagacagttgctcttgagcccttctctgaggtcctctgaacacccctactccaccatcaatcagagcagttatactttttttttttgcttttacctattaggtttctgttaggttgaaacatatgaaactgctgatattcaaccgtattacctgcaaaaatagcaatttcatataactcagcctacataaacttttcttttaacagagttctctggctaaataatttgaaaaccatttctctaggccttaagtgagcctgacattttgctggccccagtaaaattgaactctttcccttcttagacatcactagtaagagtataaagacacatgcacatgtatgtttattgcagcactattcacaatagcaaagacttggaaccaacccaaatgtccatcaataatagactggataaagaaaatgtggcacagatacaccatggaatactatgcagccataaaaaggatgagttcatgtcctttgcagggacatggatgaagctggaaaccatcattctcagcaaactaacacaggaacagaaaaccaaacaccacatgttctcactcataaatgggagttgaacaattagaacacgtggacacagggagggaaacatcacacactggggcctgtccagggggtgaggggttaggggaaggatagcattaggagaaatacctaacgtaaatgatgtgttgatgggtgcaacaaaccaccatagcacatgtatacctatgtaacaaacctgcgcgttctgcacatgtattccagagagtataaatgggtatatgcccttttcagggcaacttgtcaaaatagattttttaaaagtgttaagtctatccctagtatttaacatacataagcatgagtgtggagtttgttagatggaaaatttgtaatatatgtttcttcgtatgagttagtttcttcatacaatgtattcaaatcttcattggaaagactgtatacacacatgagaggataataaaagttctagtttttattctagttttatttaataaaggtcaaaagtagttttggactcaatgtagatattaaagacctgaaaagcattttgacctccaaaccatggagtttgtcctcatagaagctttcccagcatgaaaatagtcacaactattttgcaaaaaatactttttgacttaggtattgcaaatacttatatattaatattttatagatgttcatgtcaacttcaaatgcatccagaatttaaaataagtaaaaccagctttattttccacacttaagttctttttttaaagcaacaatttcaagtgatttgtttcatcttaggaacagcaggaaataattatgcaatggattatagaagatatattctgaacagctaaaataggaagcacatatcactgtgtgggtgaaagaaagacatttttacaaataaaggtgcacactgctttttaaatagcttaattttttaattaaattttttattttcaataattgtagattcatatgccattgtgagaaatcatagagtgcactcatgtttctttttcctagattccctcagtgggcacatctcacaaaattatagtgcaacatcgtaaaaaggacaagaaacagagcaattccatcaccacgaggatccctcccattgcccttttttttgagagggagtctcgctctgccgcccaggctggagtgtagtggtgagatctcggctcacggcaagctccgcctcccaggttcacgccattttcctgcctcagcctcctaagtagctgggactacaggcgcccgccaccacgcccggctaattttttgtatttttagtagagacggggtttcactgtgttagccaggatggtctcaatctcctgacctcgtgatccacccaccttggcctcctaaagtgctggaattacaggcgtgaaccaccgcgccaggccccattgcccttttatagctacactcacttctctcctgcccccacctccaccttaactcctggtaactaccgatctgttatccagttctacaattttgtcacattaataatgctatattaataggatcacacagtatgtaaccttttaggactggcttttctcactcagcatacttttctgcagattcatccaagctgttgtgtgtatcaatagcttgctccattttattgctggatagtattcaatgacatggatgtttaaccattcacccaatgaaggacatctgggttgtttccagtttttagctgttatgaataatgctgctataaatatttgtgtacagatttttcagtgaacatgttttcatttatctgggataaattcccagaagtacaaatgctggttggtatggcagttcaatgtttaatgttttaagaaactgccaaactgttttccaaaattgctgtacaattttacatttccaccagcaatctatgagcttctctgtatccttgccagcatttagtgttgtcacaattttttattttagcccttctgataggtgtgtagtgatatctcattgtggttttactttgcgtctcccttgtggataatgatgttgaatatcttttcttgtgcttatttgctgccatctacatatcctctgcagtaaaacgtctcttcatgtcttctgcccattttctaattggattatttttatactattgagttttgagagtgctttataagttctagatattattctttgttagatatgtgatttataaatattttctccagtatgtaccttgtcttctcatcttcttaatagggtttttcacagagcaaaagtttttaactttaatgaagtacatttttttttaaccagaggtgctagtcacaccttattctttgatagagcataaacagaggtggggagggagacagtgcaaagggagaagggcaggctcttgagagcgaggttactggcatgcagtcaggccccctctgatttggggactatcacttcttaaacacgtgctctgtggccgttgccatgccaagctcatttatatttgggaggaaggagaggatcaggacaatttatttttttatggattatgtctttggtatcaagtataagaactctttgtctaactctagatcccagaaatttttttcctatttttttctaaaagttttatagttctatattttaagtcaattatccattttgaattaatttttacataagccatatgacttaggtcaagtttcaacttgtggcctgtgtatgtccaactgctccagcaccaggctatcttccctccactgaactgcttttgtacctttgtcaaatagcagtcaggtttatgtgtatgggtatatttctgggttctctcttctgtcctattgatctaagtgtctatcccttcactgataatactacattgtcttaagtactgtagctataaaataaatcttgaaactgggtagactgattcctcccacttttttcttctctttcgatttttttttagttatcctagttactttacgtatctatgcaaatattagaataatcttatatttacaaaaaagtgttgctgtgactttgataggaattatgttaaatctaaatatcaatttggaacaatttacatctttgctacactgagtcttctaatccataaacaggtatgtctttccacttctttgaacattttttttcatcagtgttttgtagttttcagtatacaagacctgtacatgttaaagaggagttcaccgaggctcataatcaaactatcaaaaattaaagacgaagaaaaaattctgaaagcagcaagaagtaagaaacatatcacatacaaagaagtccaatgtaactatcagtggatttatcaggaaaaaccctgcaggctaggaaaggggtaggatgatatcttcaaactgctaaatgaaaacaaattgccaaccaagaatacttaaatcagttaagctgtccttcagaaatgagagagaaatagtaactttcccaaacaaaagctaagggagttcattatcactgggcctgtttcacagaaattactaaagggagttctttaagctgtatcaaaaggccactaattaataacataaaacatgcaaaagcacaacactcaatggtataagcattacagaatcacattcagaatactctggacaaaaatgttggtatgcaaagcaattttatctctagtacaatggttaatagacatctattaaaacaactataaataaaataatcaggggatacaaattacaaaatgatgtaaattttgacatccaaaacataaaatgagggatttggataaaagtgttagatttatatctaattattattttttctttttgtatttgtgattataaatgaccttgtatttttaatttctgtgtatatatgttcataactagttcacagaaatacaatttttttatgtgtatcttgcatcccgtgaccttgttgagctcacttattagtcacaggagtgctgtttttgttttgttttgttttgttttttagcttgcttcggatttctacgaagacaatcatgtcatctgcaaataggaagtttcagttttcctttccaaatctgtatgccttttatttttttgtttttcttcttggcacaggttagagcttccagcactatgttgagtgacagtggtgagcacagtggacatccttgctttgttcctaatcttagaaagaaagtcttcatgtttttaccattaagtataatgttagctgtagattttttatagatgctcttcatcaagttgagaaaattcccctcaatttctattcttttaagaggtcttaaaaaacaaaacaacatgaatgggtgttgaattttgttgaatgctttctgtgtatcaattaatatcattatgtggattttcttctttattgatttcaaatattgaatgagttatgcatccctaaaataaacctcactttgtaattgtatataattttaaaaatacatttctgaatactatttgctaatattttgttaggaattttttgtctatattcatgaggaatattgctctggggtgtgggtgtatgtggaattgggaatactaggtcataaaatgaattagaaaacattcccccattttcttttttcaagacaagattgtttagagttagtgttaattcttctttaaatgttgttataattctccaacaaaacaatgtgagcttggagatttattttttgaaagcttttttgattatgaattccatttcattaatagttgtagggctattcacattatgtattacatattgggtaaattgtggtagtttgttttaataattgatccattttagctaagttgtcaaatttatgtatgtagaatagtttgtaatattcctttattatccttttgatgtcttcagggtctgtagtgacatccctattttattcctgatataggtaatttgtgtctttcttttttctctcagtttcactttaagaacagtaggaaataacaatataatgatttacagaagatatgttcctagcagccaaaatattaataaaagcttatattgctgtatacgtgaaagaaaatttttacaaataagagtgggcattgcttttggtttttaacttctcaaaggtcattctgctttctaattcttgtttttagagatagggtctcactctatcccccaggctagagtccagtggtaaaatcatatcttactgcagcctcaatctcctgggctcaagcgatcctcccaccttagccccctgagtagttagcaatacaggcacacaccaccgtgtccaactaattttttaaaactctttgtagatatatggtctggctatgttgccaggttggtctcaaattcctggcctcaagtgatgttcctgtcttgacctcccaaaatgctgggatttcaggcatgagccagcacacccagcctgctttctaattcttaagtcatctctttactattatagtaatagtgcccatgaaatacattctgtttcaggtatcctacctttttttcatctaaatcctacaaaaactccacagatgggcagacagggaaactgagtgtcaaagatactcagtaactattggacagctttagaatccagctctctcaacacttaaaagccatgaatacactttccattacatcattctgtctttttgctataattacccaaaatgtcttcctatacaataaaaataacagaacttttttagcttaatgatagtttaaaagaatattttccccagagtatctgtaaaagcatttaccacgagggttatcacaaagtaataaatatgttagtaggtagaataaagttaaggtttaaaccagaaagatgtgacaatataagtacttctgtgaataaatttaagatggtgtgaagttttaagaataagcacatagcacttcccctggagtaaaatataatcagggtcataaaaatttgtgtcataatatgatagcaataagttttaaagtgaagataagtattacaattaattttagctaacaagttcaactccttttctgctatttttctaaaacagttataaaaatgcccattaataaaagtttgtctttttttcctgactcattcctggcaaaggaatattcaaaaggttgatatgaaggggtataagtatataaagcaagtgttaaaaaatacataaactcagtaataagcttctaaataatcaagaattgttatgatttgtatgtaaatttcatttggatttccctcaaggaaacaaaatcattaagttctgaaatagtctctaattctaaaactcctttcttcatcttcatatcaatgaaaaaattggtatcctcaattaaaaagtacctttatgtttctaactaattcctatgggttaaacttattaacacatatttgggagacaaaataggatttgcagcaaagtagaattggattcagatcctaatgtcggtatttacagtttagtatttgcattcacaaaatgaggattatataagcctccccacagaattattgtctggattaattgagataatgtaaatgaaagactagaataaggcctaaattagtaaaggattgataagtattcatcttcttctcccactgtaatattttagtataagtaggatctaactgaaagaagacattgatgagttaaatcataaggcagccctcctaataaatggcagaatcaccaaattacatgaacagtccagcagaatctccctgacacaatttacagaggtgaaggttgaaggaaaagaggaaatcaataggttcggaagaaaatacagcacacagacttattttatcagtgtttaagagagctgccctggaaattgcagtaagagctctaagtagaaaccttccgggggcgtctctgatgggaaataagtggcagagaccctggtagaacctctctaaatagcccaccatctctgatttggaggagtgagggctcatggcaatgagggaccacaaagaagggggaaaaagaagagaagatacactccaattaatcacaataagcctttttagaaagcatggcattaggaggttaaagagcccctgtggtgacttgtttacaggagcagaaagttaagaggctgttaggagcttgaagaggaaacatcagacttcagcttctgagaaagaagttagtcattagacatattttgctttagaaacaaacccaagtgatatagtttgaatatatgtccccatcaaatctcacactgaactgtaatcctcagtgttggaggtggggcttggtgggaggtgactgggtcaatggggcaaatccttcatgtcttggtgctgtcctcgtggcaatgttttcacaagatctggttgtttaagtgtgtggcacctccccaccaaccccactctctctcttgctcctgcttttgccatgtgatgtgcctgcttgcacttcacaacttctgccatgagtaaatgctcccttaggcctccccagaagccaagtagacggtggagccatgcttgcacagcctgcagaaccgtgagccaattaaatctgttttctttataaattacccagcaaagcaggcatttctttagagcaatgcaagaatgtcctaacacaccaagcaaaacataaagatggatgttaatgtgccctggtgcaatggcatcaccaaacacagataagacagcacaaaataattcttcttgatgggactgctcattcatgactctgtcatcttctccacttaccagatttaagagaaataaccagcactatccaatattaactaaaagatagatgccattctttccctcaagcacctcatattttagtgagaaagctatgaaagaggaaggtgaaaagtcctatgaagaaatagaacttcctatgaagacatataaccagggatctaacctaatttggagtgtaaagagaagcttctttaaggaagtaatctttcagctgccacctgaaggagatgtagaaattagctaagtgaaagcagtgtgagcgggttaaaatgaagtgtccaagtcagaaggaacatgaaatgccgtaatcctgatgtttacagcaggaaaagatacagacagcacatgtaaggaactaaaaggtggttgatgtgttcgggatacaaaaaggaagaagaagagagagaatgggcacatctttccagaagtttgtgaaatcgaataaaatttgcatagctatgggagatactattctatgatggcattgacttgagtacattaaaatgctgatggaaatgaggtggtaaaaagagatatattaaagagataagaacaaaaaggaattgagagtaaaaatttcctacaaaggaggtaagggtggaatttagagaatgtgtgaaaagtttgatgtttagagaggcagaggaatgccttcagtttaataggatggagaaagaaatgaagaggttcagaaaggttttaaacattttttggcaaagtattgaggtaattccttgttgatgacttccagtttctctggaaagtgaggattaaattatctgagtagactaggaggaaaatcaggtatctgtgaagagtaaaattcaaaagtcattaggaaagttggcatgcaagctaactggagaaatttaggtctgctgagtagtgttaagggcccagaagagattgagaactatgaatttataacattaaaataagattatgaaaaaattcaacatcactgatcattagagaaatgcaaatcaaaaccacaatgagatatcacctcacaccagtcagaatgactaatattacaaactcaaaaaataacagatgttggcgaggttgtggagaaaaaggaacactcatacactgttggtgggagtgtaaattagttccattattgtggaagagagtgtggcaattcctcaaagacctaaaaacagaaatacctttcaacccagcaatcgcattactgggtatgtacccaaaagaatataaatctttctatcataaagacacatgcacttgcacgttcactgcagcactattcaccataacaaagacatgggatcaacataaatgcctgtcattggtagactggatttaaaaagtgtggtacatatacaccatggaatattatgcaacagaaaaaaaaaggaatgagatcatgtcctttgcaggaacatggatggagctggaggtcattatccttagcaaactaatgcaggaacagaaaaccaaacaccacatgttctcacttataagtgggagctaaatggtgagaacatgtgaacacatagaagagaataacacacactgggacctattggagggtggagggtgggaggagggagaggatcaggaaaaatagctaatgggtactaggcttaacctgggtgatgaaataatctgtataacccccccaccccgacacaagtttacctatataacaaacctgcacatgtacctctgaacttgagggttaaattttttaaaaagattatgaattgattaacttctcgacttaggcttttttctattttacctgaaaataaatgaaacaatttattagtctctcactatttactcttgcacatatacatatatatccatatataaatgagttaatgcttttgcatttatttcagtgtaatataataagtagggaaatacgatgtgtgattattatatagttattatggattatgtactttatcaatataaaaatcctatttattcctatgctttttatctcagtggagtccaaggattaggccatgaaggattgaaagattcagagcaatgttccaggcagaagcgtatgttttgaaagagcatgctgcttttgaggaagtaaaataaatctaggtttggaatatagactagaagagatcaagaagtaagaattaactccagaaataaacagaaacctggtcatacagtttgatggctttaagttgaccaagcaatggtggtcaaacctgtgcttagctaggcttaaaagctatgaagtaaatagacaggtttgaaaaaaatagactatcactttgagaaacaatctggattttatgtgtactattttatttaattttttcctcctgtacaggtagcagaaacacacacacacacacacacacacatacacacacacacccataaggaaaattttaacttgtctatctatctatctgtcatctatctgtctgtctgtctgtctgtctagttaaagcaaactaaatatggcctgagaaggactccatacttccatatttgaatccttgtggatgaaccataacctagcttaacaggcagacaagatgaaaacctaacttaggagtatgtgcctgtaacaatagctgagtcttggccaatcacagcagccatacctcaaccactcatagactgctaagtgttcaaacagggttcaattaaggcaaaagccaacctgtaaccagccgtttctgaacctcacttctaagttcttttctgtacctcactttcctttttatgtctataaattagttctgaccacgaggcacccctggagtctctgaatctgctgtgattctgggggctgcccggttcacaagtcattcattgctcaattaaattcctttcaatttaattcggctaaagtttttcttttaacaatatataaacacacacccacagttgtacatattacaaatttgcaaataatctgtgtatatttatattcagtttattttgtagttaacagttaacatttttatagttaccatataattaagttattcatatgattaaattagctttcaaataatttttaatatttttaatattctatcttccattcaaacaaaaatttttattctaattcttttctgttataaatagtagtacaatgaattattttacagaattgtttcctctttctgggcatttcattggtacagacaagaaagtactagacgaaaagtagtatgtttttcaagattcttgattcacattaccaagaaaatgtatagaaacatttccaccattgttctacaagactatcagtctgtgcctgcatcaccatgaatttaccatgcatttgctaagcacaggatatatttttgtttttaaaaagttttaactacttcttaggttatgttataactttattgtgcatttccttgatattcagcgccattaatcatttttccttttatttattattattctttttctttcttaaattgggtatttatattgtttgtccattttcctctgtggatgtgttagtcttctttgtggccttctaagagctctttgcatattaaaattttaacagtttcactgtttatatttatctctatagcattagttacttgttttctattttaataaagtttttttgatgcaaggcaacttaatttctatgaagtcaaggctatttatcttttcctttggtattactttcacaacttttgtgttaagtaaatgtttgtatctgtaagattatgttcgaaatattgacagtgtgtgtctctatcttttcatacattttgttagttaatagagaaatgactgctgagctaatcatttgtaactgttgtgacagaagaaagtgaagtgtaaagatgagaagataagaaaatgtgtctctcagagttgttattaatcaccgtcaatatttcattagagtgcattgcctaatgtctgtttatgtaatttaacttttttgaaatagtctttttcctcacatattttgactaacttaatgacccacttaatttattatttcatgtataattgcaattattatgtagatatccgtttgtgttgatatctctgtttttttaaatggaaattaatagaagatataaaatacttttggatctttctgatattcaaaaaatatttttgagaaaaattatcttaaatagtaatatgatttggtacttgactcaattcaatttagcatttattgcttgctgtctcatacaactgttctaagaattcatgtcaaattatatcagttattcctgtgtccatttagcatatatttattgtcaagttcttggctaaagcaagaatccaagaagagaaatttcacagactagtaagagattatttgcaatttctgctttttaaatagtaatgtaattaatatactttccagaaaatttttccatcttctttgatgcataagtagactcttaaaatacacatataaaattatgtgaaagtacacataattctaagaaagcatagcagaagggctagagacccttatatttaactatctacattatatctagagggtatctaaaacttatacaaaccaaacagacatttgatccttgctccccagttccagcaacatcaaaacaaacacaatgaaaatcactgatttttgcctagatctcaccatttcagtaaatggcatcgtgatttttcacagtgactcaagccataaatctggacatgcttgattcgtaacctgtatctcctaaattcaactctatggtaaatattattcattctactttgaaaacatgttctaaaaccactcatttccctatacttcggatttacccaccaatccaaataactgtacatgttctcttggacagctacaaaacgtcctaattgtttcccctatttttccctccataaggtattctctagccagagtgatcttttaaaaatgtagatcaaatcacatcacattcttgcttaacacccttcagtggcttctaattgcacttggagtaaaatctacacttcttaccatgacctcattggctctctgtcttctctggtttcatctcacagcactttgccctcacactgagctccagtcatgcatgccttctgtctgttcctctgctccaagttcatgtcttcatctgggtctttgtattgctatttcatttccctgcctggaacattcttcctctgactcttttcatggctaactgtttctcctcattcatgttccagctcgaataccacctcttcagagaggccttctctgattccaagtagtgactcctcctccaaatactgtttgactctgtgtagttaatttacagccctgatcacaatctgaagttatattctctatttattgttcacttgatcattgaatatttacctcctcttgaatagaggctccttgaggacagtgaactcttttgtcttgctcactgttattacctgtactatgatgaagcctggtaaatagagcacacttagcaaatatgagtaaaacggatgaatgaataagggcatctcagtgaagatggggtgagaaagggttatgctagctggtgcttggatcctacctaaaagaaagaacagaagttaaccaggtagagaaaaagagggaaatgcattctagactgtatcggaaagggtgcaagaacaagtctcctttggagagttgcaggaatttgggatgattgcatgttggcattgctggtgataaacaggagcccagtgcaagaacatttatggacttttatgccttatcgagtaagaagtttagaggttgtcatgaaggtaggaaatcctaaaggatgttataaaagtgaataacataatcatgttgacaatgtaataagatcactctcctcacatgggaaggagtctggcattgggtgagtagggtatccttgtagggtatcctcctactggcagtgtgaggaggtgtccacatgtggagggcagccagggtagagtcaaggcactgtaaaggtgagaagggtatccatcaggggccaaccaggcatgaggaatcagagcatacacaaagtaaggagcagggtggatgtgtgtgtgccatgccctgagcaggaggtgtccatgtggagctttactggcatgcggtatcagagcccaagtgggatgaggccagtgtccacatttggagatgaccctaaatgagaatcaggacctgatataataacaaaatacactatgaataaaggaagctaggtttctgactgtcagagaatagaactacaaatataaaaatgaattatgtgttgtttagatcgaaatcacattacttctgtaaactcatggctttcaatatatgttgagatggatggacacagaaatatagatgttcctgtgcatgtgtatatttgtgtatacatacccagacccacgtgcatacgtatatgtacgtactatgcttatatacaaatattctctagccctgcccactgagagagtctgagaacagtgacatcccagtagcaattaatatacgtagtgcctaaatcttggcattaaactaccattttatactaagaggaagtaaagcttcttagagaaatagctgattccacatctaggactggaaaatcatatatgagataagcctagaaatcccgatgttccagaaagtaaggaatgctcaaagagtgatggagataagtcaaaaggacacaggaggactccctttggcaaaactctaaataattcaaatatcaaaaccaataataataataatggagtataactaactcaataaaataggaaacatgggtctctgcaagtataaacaaatacacaagtaaattgaacgttttgtgaggaatgggatattcacatagttttaaagtacctccccacaaatgtatacacatttcagaagagaaacaaacaaacaaacaaacaaacaaacgaagagaaagagtaaccttacaatggagaagtctgaaagaaaccaccttaatcaagtgaccaaggtgaacatcatttgaaaaatcattatcacaaatcaaaatcatgcaccagctgataggatgcaataagaaaaacagagtcatctctgggtttttctgacaaagatacataccctgaatctaattataaggaaatatcagacaatccaaattgaggaacattacacaaaatagctgacctgttatattcaaatttgtgattgcttttaaagtcaagaaaagactgaagaattattccagatcaaatgagattgaacaggaatgaaaactagaagaatgtatgattctaaactagatacttttaccataaaacatattattaggacaattggtgaagtttgaatggagtcttaaggttaaatggtagtaatatatcacaattcattatctgattttgatgtttgtgttctggttatagataaatatccttgtttgtaagaaataacatggggccgggcgcggtggctcacgcctgtaatcccagcactctgggaggccaaggcgggtggatcacgaggtcaggagattgagaccatcctggctaacacggtgaaaccctgtctctactaaaaaatacaaaaaattagccgggcgtggtggcaggcgcctgtggtcccagctactcgggcagctgaggcaggagaatgacgtgaacccgggaggcgaagcttgcagtgagccaagatcgtgtcactgcactccagcctgggcgacagagcaagactccgtctcaaaaaaaataaaaaataaaaataaaaaataacacaccagtgctaatgaggcattagaacagcaacttactcacaaatagttccaggaaaaaaaaaaaaagatctttagaaaaaaaagatctttgcattgtgtttccaacttctctgcaattttgtgattgtttcaaaatataaaataataatcattttaaaatccatgaagatcactctgtgataaatatagaagataaattagaagtagaagagatgacatcaaggaagccatgatgggagctatttcagtaatcaagtcaaaagaattaagacaggtacagtgggagtagaagagaaaagcttagaaagataggaaacagaagtgacatgctttggtggctaatttgatacagaaagagaagtagaggaggagtctaggtggtacagttaattgatataaggaaggaagagcagatttttggagaaagatgaagattttgatgtctggcaagtaagtgtagtgagtcttatcttccaaacactgtacgttacttgaccaaatgaaatacaagttattggcttattgttaggatgaacttctattctctggcttcatgtttccacaagaagggaataccattagagtaacatcctccacctattctccgactccttattaatttatcccctaaggaattagagttactgagctgtaaaacgacattggggaaggaactaagcatgcttattattgcctcttccatgtttctcctcttcagagacataataaatatgttctctgctcttctgtagtaaaatcaccttgtaggttggctagctgtgccagtgactgggttaggatgtgtgtctaatccaagagtgaagttacagcaagcatattcagtaacatatctagaatcacattgtccaatcagttctcatgatgataataaaaagtatggcatttggtttcaatttgtctaactcttggattccatacctcagttggttctgaatctgggagagaaagcaagcagtgtggttaatttgtttcctaaattcaaaacaattataaaactctgtttattcctcccagtgtctaatatagtgcttaatactcacttattgaattgagttcaattaatgtaaaataaaatgatgctaaaataatactgtcttaaaggcgaaaatataggtccttctaattatttgtttttccattttaggcatttagcaccattgatttaaaacttgttcttcaacatgacataatctaaagatacttatttttcctttcctcacagataaaacagaaatcataatggtcttatccatctcacgtggtttctcaaaggattaaagtagacagtgtgtagataccactctgtaacatcataaataaatggcatatttattgctgagtttgggtgttccctttctcaacagtgtgaatttgtgcaagatgagtggaaaatcaaaccagaatggaattgttagggtcagctataaagaggcctatgaaatgccctagatcatgtttttcaaattaagttttgtgcatcactagttgtgaaatatattaatgggtttacatgggtggtagcgaaagaaggctctgaaaaatcattcagtgaagaaattatttaaccctgtatttccccaatatatttgacaatggaaactttttatataagaacatcacttacagaatgagtaatccatagatattaggacattctgactaagaggaaggtggcagaatatctggttgggacttcctaattattagaatgccctaagtaaatcagcacagcacttaagtaaaaagattctaaatcccttgcttatcctattcttctccctggactatgtatctgcctgctacgatatggatatggcttagtttgtccccaccaaaattcagattgaaatttgattcccaatgtggccgtgttggcaggtggggcctagtagagggtatttgggtcaagaggacagatctctcatgaatggcttggttctgttctagcaatactgacagttccaagtctgccaagactggattaattctcatgggtatggagtaattcccataagaggtatttgttataaagccagacaccactggagttttgcctcttcacatgttttcactttccctttgaccttctgccatgttgtgatgtatcaccagcagctgggcagatgtcaacacgatgcttcttgtacttcccagcctgcagaagtgtgagttaaataagcctcttttcttagttcattttatgttccatataatggaactcccaacctcaggtgttccattatagcgacacaaagtgaactaagacttcacctatctaatgcctattcaaacataaaggtcactttgagcatttcctctctggaatagtcttcactgccctttccccaactattcttaattaattcaggtggtacttattgacagccagttgtgaaccaggtactgttctcagtgccgaaattgagcactttataaaacaaggaaggaaggagggaggaaaagagagggatggaaggaaggaaggtagaaagaaataaaggaaagaagttcttattctcatggcatatccattccaggtgggaagaaagacactgaacaaatcaacgcataatgttagttcgggagtgaaaattgttataaaggaaaatagcataacagagacagagaataaagtggtagctactttatattcaatggtcaaaaagggcatctctcataaggtagtatttgaataatgacctgaaggaaggatgataattagcagtgttaagtctctgggagaagggctttccagacaattcaatgataagtacaaagaacctaaggcaggagctgtttggctaatctaaggtactgttgggaagatgacatggctagtgtaaattaaacaacgtggagaacggtaggagatgggttaagaggttttagagagtcagattatattggatgtcatgcttctttactttcagtgagatgggaagacattggaaggttgagcaggtgaataacgtgatctgatttatatatgtggccaagttacaaaaggacaagagcacaataatcaatgccagtaacaagatatgaagctttttcaaaggtctaggccagagatgttagtggctcatacaatagtgacagatgacagatggtaagattcaagatatatttttaaagaaaagttagaggactgatttttgaactttttggtctcaagatcccttgatgcccttaaaaattaataacactgaagattttttgttcatgagagtcatatctgttaatatttatataaaaactaaaaataaaaattctttaagcataatacacaagtgcgcattccattagccatcagaggtatgatgatgtcatcacttaccatatagcttctggaaatctccatttagaactcatgtacaaataaaagcagaacaaggcaaaatgtctttgtattattatggaaatatttttgacctcacagacctttgaaaaggttttgaagcctgctaagaggtcctgaaccacacattgagaactgctggcctagaggatttttttgatggaatggatctgaggtgtgagagaaagaaagaaatcaaggatggggtcaagtttttaagcctgagctgctattaactgaaatgcaaactgcagtgctatataagttaagtttaagacatcccattgagatttagggtagcctgctggacatgagcctggagttcagggaagtgggcaggcctggagatacaaatttaggaataatcagcacataaacagcattgaaagctctggaactggatgagaacacatggggagtgaaagtagactgagaataggtctgaggatgatccttggggcattggatcaatgaactccatcagtgaaattccaaaagttctctatttagagcacagtctcctttggttggttaaaagttattttaggatagaatccatattttagtcattttcatactcaaatcaccgcttaagatgcccagcatatggtaggcactcaactgtgtttattgaataaataaataaattaattaatgatgtcctttgtggtactttcacagctaaattccagaattttagaacaggcaagattaggaagttggaatgatcaggttcagattcatacagtaggtatactattcattgtatagtcaaacagatttccttgaacttagaggaagatgtaattgactgcaccctgtgctgtcaataataagtgacctaaagggaaggatagactatatttcaaattctagtctgccatttaagatatttaaagcaataatgccaactctactttctgatcattttattttgcaaggaaattttttcccagaatattttttctttctatgcattcttttatttaattacacaataaatttaaccagctttacagaccaatacatatatatctacaaaggatgtatttcatttttgatgaacatactatggcttatttaacaagttatccttactaataggcattaaggtttccaataaatatttcaataatgaacatccttgaacatatttttatttatttattaccattttaataaccacatttattttcattattcttatagcacatctattcttagccactcatgtgatttgaaaatacttttatattaaatgtctatttaatcaatatttcctcatctttataatgattcatttgcatctcttccaaaacttcaagttaatgtctaaactcaattttcttttgtttctcttcttctatttttattttaggtgccaggggtacatgtgcatctatgctttctcattcaggctgtctagacatgctctaggggaaaaagctgagccaaacaatgacacccactgagaattttatgcatgtgggagaaaaacccctgaataacacaaaaggaaaacacaatattaatacagtcttgctattactggcaatgtgggcacaaagtataaaaaattacatttcatgtttaggaaaaaagatgaaaaaatttttttacttgtagaaagtgccaaataacaaaaattctccatattcctgtaggataaactcacctggaatttcatcaaatgaatagaaatgaggatgaataatattccactggcatataattggcatgaccactatatggattgaaggtgattttaatcatcaatggaagatacaatgtacagtggttgttttctggattccggcttttccctcccctgtattaggtcagcctgaccctgtactgtgccatttatcctcactgactcctcccatatcccaaattccaggagtttatacttcctgtggctcacttaagcagaggcatctaaagaatgagatgcttgaaggtgagtatcaccccatatgtagccaacatcttcttaagtaggttccaatgatttagggaactttaaaaggttcccaaatacattttctaaaatccacagttgccatgatcagagctacttggggatgacacagagagttagaacattacttctcagaggtcttatttcaattgtaggcaaacatgatctaatcaccattataataacaagttgggccactacagggctttacaatgtacacagcaccatggcaccttttatctggtttgagtctgactacacccctgagaagcaggcaaggcaaataccattctcactttgctgaaaaactgagggtgagaagggtaatacagagtgcatgtgacagaagaaaggttggaactaaattccttttaaagaggcacctacaagcaaaattttgcacataattccaggaattgtgtagaccacccatagcctatccaagaacaccaggttaaaaatatttgccctcagacagactgatttaattggtcaggggtggaactcaggtatttttttaaaaagcttcccaggaaattcatatttgtccaaaactacttcaaaaattcatatttgtcaacgttgactgttgggtcctgttgccttctttctcattttttttcctttccaaatcgctctttgttttacttaatattattttctattacgtctatctttctgtttttagccttctcttctcactcagcttttgttgcaagtctggaaattactgaatacagtcttctttggctctttccttcagactacatactactgccatctatgtttctgttcttcctcctttttcaaaactattattctctcctgaagcttcacccttctagaatatcagtattccacctcgattattttctacctaatgagctaattagcattaatggaaaaactactgaagttaggaaatcagagatcttccagtaagtcagtggcctcaggcccaatcagtaaaataaggaaaaatatacctacctgatagaatttttgtgagaaacaaatgaaacacatactcaatcatgggaataaaatactcaatactcaataataaaaatatttttaaagactatctccttgaagttctttttattccttatctattttttgctgcaacccaatacaatattctgtactctttccaagttatatgcctctgttttttacatacccactctcatttctaattttaaaatttagcatatgtattctataaccccacagtgcccagaaaaatgttattctggatttggcaagaattttttgtaaccccagttctaaactgttaataatggcagggagaggtgctatggcttattattaaactgctttattgttagctcattaatcatacacaggtccagaagaatattcaaaatgtttctttcaggttgagtaggtacctgatctaaacatggtccattatgagtaggtgttcagaaatgactcatctttcctccaatcatctcctttagtgtcttgagagctctgagcctttgacctttctccttattttctttacctctacagcctctttgcttctttttgctatggtccctccttagctgcaaaagaatgcagcctggtgttatttcattctattgaattccatttaggatgaggttttgggttagtggtgaggtttggatggtactaggaacatctaaagccaattggaatgtcttttccggctgctattaacaaataccaaaaagttatggggtctctcccagttctggaggttgagaagtccaagatcaggtttccaccttggttgggttctggtgaaggtcctctttcagattgcagattgccgagttcttgctgtgtcctcatgtgttgcaagggtgaacaagttcccatgggcctcttttataagtgaactaatcccattcatgagagctctgccatctgacctaatcctctcctaaaggccccactttttaatactattacattggggatttgaattcaacatagaaatttggggaaaacacaaatattcagatgatagtacagaatttcaaattttccagattgacttcttaggatattcttatgctcattatgctaaaaatctctgttcaatattgagcccatttagatgacttgtctgtggtattgtgccaaaatagcctctttttctgcccgtggtcacttctcaagagcccccttctattttagacttgatttctatcatgaaacagggaaaggagtgtaaaaacccatctagctaaaaccaccacccagagcacagaccaggaatccagtgctctgtcaactgctaatgttagtttgtttgaactttggaattaattagatgtatacacacctcctaacaaaatatttaacaattgagtccctatcattcatgtctcttcagtcaacttttaggctcttctttctcattctctgcaaccagaaactgtttccccacctctgctcatcctttaacatgctgtcatactgccttatttccttttaccatcaaactactaaaaagattagtctacaatcagggtatcttttcccactcttcaattcctttcatcttaagcttctacattcttcacctgaaggaaattgcattcttgaaggtctctgccctcataattgccaaataaagtgacattttggtctctcttctcctctatcttcctggaagttttgacaatgttgactaatcactttaaaattttttttctttatatccacagtaagagttgtctttcttcttttatttttctcaatgattctctctctcttttttgctaaagacttctttctaaagtacatgtgaggaaatcacttaagttcctggttctcaacttcctcacctataaaatgaaaatatccattccaaaaagaatcatgaacattaaattatattaggtactccaaaaatataattatcctcctttagtgtaaacatttatcagaattctgtctttggtactatctctcttcatcattgaattttacgaatgagaataaaatctttaccttaagccctcaactctctccagaaccccataccaatatttccaatttgtatatcatgcttcatgttcagtaaatctacaaaaccaaacttatcatgtcatcttctccctcatcaaaataaacatctgttcaattctttcctatccttattagtagcattccaaagtcccaatcaacaaggctcaaatcattagtcatctttggctcccttagacctaatccatctatctactgctaattctttatccaaagtgtctcttgcaccaaagactacataaaatgtataaaacattatagccaagtgttacttatattagcatccaaagtaaaacaatgtaatctgccatatcaacagaaccaagagtacacgcaataaactgatagcctacattgtagttaatgttgaaacactgtaacattgtctgctttccccaaagatagggaacaaggcaataattcttggttttaccacttcattgcatcattttactatagtcacagcaataagaaaaagaaataaaaggcacaaatattagaaaaaaaagtcaaactatcattattataagatgacataaaagaatcctatggaagttattttttaaaaaagcaaacaagtactctagcatttaaataaaattaaaatggtaatataaaactcaactgcatttctacatgccaacaacaaacaattaaaatatgaaagcaataaataatactaaattattaactcagtaaataacaatttttttccttgtagcaaaaattaaatcttgacccccacctcacaccatacacaaagcaatctgagatggattatcgacctaaatataaaaaccagaacgagaaaacttctagaaaaaagtgggagcatatatttacaacctgggacaagtcacaaaaacactaaccatagaagaataaaatgatacatctgacataaaaattaaaatattctgctcatcaaaaggcacttgagaaaatgtttaggcaaatcacagagtaggagaaaatatttagagtgcatacacctgagaaaggacccatatcttgtggggttacagaagaatttataaagaattactacaaataaacaatcacaaagctgaacacccctaaaaaaaagaggtgagcagatacttcacaaaagaagatctaagaattggcaataaccacagaaaaaggtagtcatgatcattagtcaccagaaaaaatgcaaattaaaaccataatgagaaatcatttcacacccagaagaatggctaaaataaaaaagtttaaaaggcgagaatgtggagaaatgaaaattctcacacattgctactggtgactataaaatggaacaacttttttggaaagctgttgggaagctttttataaagttagctattcatctaccctgtgatccaacaatgccattcttatttatctatatgaaaacatatgtttataaaaaacacttacatgtgtatattcatagcatattcactcataatggtaaacaatgggaaacaacgcaaggatcaatcaacaggagaattaatgaacaaattgtaatataccatagtatattaatccaatggtaaaccacttaccatgaaagaaacaacatggattaatttccaaaccattatgttgagtgaaagaaacccaaacagtgatacgcacacagaaaacatactcaccataggattccatttatataaagtccaagaatagccaatcctaatacatgatgataaaaatctgaacattcttgcctccaaggcaggaaggagggcaactaattagaaaggggcaagaggaaactttctggggtgatggcaatgttctatattttgttttgagtggtgttatacctatgtaaataattaaagttcatcaagctatatacttaagatctgtgtatttgattcttcaattgtgaaaaacaagatgtttcacgaggaactattttaaaaacaaagccaacacaagtaacatataactattcagtaaaaagaagataactagaatgtcaatagacctacctaatatatatttcaaagatttttttttcaagtatttaagtacaagtaagtagaaaaattcaggcttgtgggttaatatactggagagaaacaaagagaaaagagtaataaccatttcagtcactctgaatttgaaatagattgcttcacaatctagaggattttaagacgtgaaataactgaaagaaacaaaggtgaaaaagatcaaacacaggatgcagaactaacagctgtgacttagttaatgcatatgctgaataaaaacaaactcaacaaagcactgggaagccggcagcttccaagtaattaactaagcagaaacacatgcaatgtgttatcagccctatctcatattgaaagcaaggactccttcgttacaatggatgctctccatttacaggtagagttacaagaaaataaactacataaaggtatacaagaggcaaaggaaaaggaaccaatttgctacatctaagtagtatctattttcagtgaatgagataaaagttctgccgttacctcacctactcaatatcagtcttcccacaataaaagactgaacacatcagctaatggtcaaagaattgtaaattcatgaataagggtcacatttacatttttattttcaaagttcaacacaagttttaaaagtgaaattatcatttcaatcatattattaatttttaataaataaatttttagaacggtctttaatacccataaatcaatctaactccacactttctgcattttcagagagaaaaccagaattaacaaatatgttagagtattaaacctgtgattaaaatataggcttttatataagttcatcaataattatcttttctttggaacagtagctctcaaccattttccatccctgacacacctgtgatttgtcagaacacagcaggagtctcctgttctatccatccatccatcctctatgcacatcctctagtcttcaaatcctttcctgaaacctcatgtcctacctgaatactctctcataagtatttccatgtgaatatactactccctttctacaatgaatgaggagccccctgaaggtcataactcatatggagaaataagtcatgcaccaatgtctccagggtggaagaaagagtagcctaattgaagttatattctttctgcaattatatatagagaaagaaaatatatagatatatagctgttattgttctattacataaatacaggctgcattggttctaatttaaacaccatcatcctgagttacttaactttctcacttatttgtttttctccttaaagcattgttataacatttaagaaagatggagtcagttactaagataaacatttaagtaacgacagcaccaagaaattgggtcaagatggaatttctggctttaattctacctctagatttcttcaaagataaccaggtgaacctaaactcaattagaatatgcagagaaggatttatgaaataatgcctcagttattcagatcatggatctatagaaaagaatctgtttttcattcattgaatgaccaagtgcatttacattagagaatctacattggtataaaaacaaatatatttaataatgaattttattaacatatataggacaatgtcttacttaaatagctttaaaatgctggaaatgcactagaaacacattaaccccagaaacaccttcatatgagagaaccagtgtcaacgaaaatgacagatagcaactaaatctgggtttagtgaggtttatcttgaagcaaatagaccccatcaaatttccttgaaaaagaggacattttgtaatgagatgaaggtgtcactatgttacccagactggtctagaactcctgggctcaaggtgattctctgcctcagcctcccaagtagctaggattacaaccgtgtgccactgtgcctggcagaagacgacatttttgaaaacatttttcttctccacatattggggcactatgtcaaatgttacctgtgcctaaatgcccctgaacctgcatattccatactcctaaagatgtgtcaaattatacaacctcatgaggatatttttaacctctgagcaggactggaagaggcaaatatactaaagtaaaaaaaaagaaactccaaatcagttggacaatgtagcccctttggagtgccagtgatgttatctataaacactgaaacacaaattgcacttgaattgatgaaggatataggaaacaatttatattaaagtgttctacaaactgcagtggctatccaaaatttaagtgccattttatcaatgaggatgaagattataataaaaatgatctaaaataacttatgttaaacaaggaaaaatattaaacaaatcttgcttatttagacctaaatagtcttaaaagacacattttccctacaatttggctcaaaggatttattcatactctatatctaagtagatgatgaatggcattgattgaatccaaagtcctcctgtcttggattttatgaggcccattcagaacgagccaggttgagaacaccaccaatttcgtgttctgggtccatctgttggcaaaaatataatgcaaacagctttataagtgctattttcaatgaaatatcacagaacagcttgtcccaatgatatttctaaagcttgcctgcaaaccgcctactggaaaatccaactgaaagagaagggagaaaagagagaaatccatagaggaaagagacaggaatggaaaaaagaacaaaggataaagagagactagctagaggactgggaacactggaggaaaacaaggagcaatattaaacgcagacaatattcattgaaaccataagaatagagaagatagagaaatataaaaatcacttgggttggaagacagagaaataatcacaaaccatgcagcattgtccagaagaatgaagacaaaaggatcaggaaacaccagaaaatatgtaacagctcaataattggagcataattattaaaatgttgtgagagaaaaatgatgtaaaatagctatttttctaagtctcactgcttcatgtaacaggcacaattcatttttccaaaaactaatgcagatttcagtgtttatcaccaacttgaaaggaagcaaacatcctcttctgagtcccctcttttaatttagaaatccattgacataccacataaaacagtccaggcattgcaatataagtgatgtacatgcattgattcaaatcaaaacacattagagggaaaatgatgccattctgggcacttacctggggtcgaatgacttttacaatatttttgagggcagtatcaggggatggaggtgaacaatcaggtgttgggcctgttgagctgtttctatggttactagttcctggagtagtaactgctacctcagaggcattatctgtgaataaaaatagaactgccatgaacctaatcactcagtttaccttttaagacttgaaattaattttctgaacataaattgagatttcaacttttaaaactggtatcaattacaagatcataatgaggaatatgctcagtagtatattttaaagataatgctttttgaatgctttgtttccttctaaaatggtaactatcaccccctggaatgttgttctgagacaagtgtattattattcaattcataatgatagattatccagcatagctcttaagactgctactactatatgaataactaaaaccttaccttaactaaaaagaatataattttatgatatgattgggctaaagctttcccaataatctcttaaatgagtattaatatttattaaagtgggagttttatatctccctgatgcataaaatccaaattcaagcctcctcaaatgacttttcctagaaatcccacaaactatagaaaagcaccctagtgaatgaagcttgatgaaaaactgaaatttgtgcaaaatggttttatgatgtagataaacacaaaattatcactcctagataagtatagcaacctatgtggtcaaagctaaatgaataaaatttcagaatctaaattaatcttctcttatgttcagtatttaggaggggggaataaagaaaagatgacttgaaaatcaacaacatgtgtaacatttttttcttaaattcatattaaagcaaaataacatcaaggatgccattttagaatgtttaaaatacttgggaaaggatgaaaattattctataaataacttctggtagcacatagaaaagttattttaacaacaatttggcaaacttcaatagctttttatgaaaactgctgcaagctcaaatctgccaaaaaaataaaaaataaaaagtttacttctctgttgtttttaattagttcccaataattttctttcctagacagttagctgaactgattgcaaaagagactgagactgaattttttatagaccaggaagtttctctgttcctgatcgctgtctacaatccccagtgaaatacaggaattcatcaaggcatcttttcctcataaaacacaaagggatgaattatcataaaactctacctaccatataaaaatataactcagtctcactgaggaatccagacaaaggcccataaaacaaaaaattcaagtatgacacatagaattacttggatgactcataaaataagtcttaaaagtgtccagagcacactcttctaagatttaacagaaaaggtgggatttgaattggcatcacaaaagagatggggtggtcttctgagtagattagaaaaccatgagtcaatactgaaacacacaaaacattagtcagcaagatgctctgattctctccaacctatcccttccttctttcattcatctaaaaactacacatgtaagaacacttatttggggcaactatgagtcaaatattatgttatgttctaaagattaactaggaagaatctctggccaaggactggaggcaggtagggatgaataggttaagcactgaggattttcagggcagtaaaactattatatttaacagtataatggtgagtatacatcatcattatatatttgtccaactcatggaatgtataaatcgagaatgaacctgtataaactataaactttgggtgataatgatgtgtccatgtagtttcatcaattataacaaaggtatcattttggagcagaatgttgatagtagaggaggctttgtgtatgagaatatatgaactttgtaatttctgctcaattttgctgtgagtctaagaagttctaaaaataaaatctatgaattttttttcaaaagaatccctgccctcgagaagtatactgttgggttttttccttttcttttttgagacagggtctcactaccatcacccaggctggagtgcagtagcatgaacacagctcactacagcctcaacttcccaggctcaagtgatcctcccaccttagcatcctgagtatctgggactacaggtgcacattaccacatctggctaattttttgtatttttagtagaaatggggtttcgccatattgctcaggctagtcttgaactcctgagctgtagtgatccacccacctcaacctcctagagtgctaggattatagccatgagccactgcacccagcccaaaagtatactcttaaatgtgtcatcagacatgtaaacaaattacaatgcaatataacttgagaactgataacagataaaggaagcatgataaaaaaaaaacagggtggggtgggggagtaatcagactatggcttggacagaagatagctgtgaaaggcttcagttttcaggcaagaaagctggaacaaaacattagatattagggcatgaaggtaggaagagcacagttgaagctgttatttcatatacaaaaaaactggagataagtttgaatgagtgaaaggaagttttattagaatataaacatacttaattctgtaggcaatgagaaatattgaagactgagcagggagtgacataataatagataacttttattgagcatttattatgtgcagacaagccatgttaaattattttacttattgaatctcatttaatacccaaattaacttacaaaatacattccactatcaccatccctattttacagagaaactcatctcaaagttatattctcagttactggcagaaaaggattcaaatttcagactgatgccatgttacccttctgagagttagcatgtcatagcaggtatgcaaaagatatgcataggtatgattgggttcatagaaacatagcctgaagaagatcggcatagttgaggtaggagcacactctacttcaaaatatagttgaaccaacttccagaaacttaaaaagtagacatagacactatgaaaaataaataataaaaacaacaaaaaagtcaaccataaaaacatctttagggtatgcctttgagtactatatagtataatatttaatatttggaagctggaagatatgttaagactagagacccaagctagaggtcatgacgttagcattttggagttgataagtgattagattctggacatgtgttgaaatgtccagaactgttgaaatagaccaagaatttttttgatggctcctgaatagacaaagcaaccttgaacaaaaagaaaaaactgagcacattacactacctgacttcaaaatatactacaaagctataataatcaaaacaacttgatgctggcatagaaacagacacatcaaccaatggaaaagaacagaaatcccagaaataaatacacatatttttggttaatttatttcaaaggtgccaacaacacacaatggggaaagggcagcctcttcaataatggcattgggacactggatattcacatgcagaagaataaaattagaccttcatctcacactatatacaaaaactaactcaaaatggattaaagctgggtgcaatggtacatgtctgtacttccagctacttgagaaactgaggcaggaagtttgcttgaacccaggagtttaaggccagtctgggaaacatagggagaccactctctaaaaaaacattttcttaattaattaaagacttaagtgtaaaattgaagtggtaaaactattagaagaaaacacagagaaaaacctccacaacattgatttgggcaatgattttttggctatgacctcaaaagcacaggcaagagcaaaaatagacaaatgggattatgtcaaactaaaaagctctgcacagcaaaggaaccaatgaagagagtgaagaaacaatttatgaaataggagaaaatatttgtaaacagtacctctgataaggagttaacatccaaaatatatggaactcaaacaactcatagtgagaaaacaataacctgatttaaaaatgggcaaaggatctgaatggacatttctcaaaagaggacatacaaatggccgacaggtatatgaaaaaaatccctaacaacactaatcatcagagaaatgcaaatcagaactacaatgaaatatcatctcaccccagggaaaatggcttttataaaaaagacaggcaataacagatgctagcaagggtgtggagaaaggggaaccactgtacactgttaatgggaaggtaaattagtacagccattagagagaatagtatggagttcctcaaaaacaaaatatagaattaccacataatccagccatcccactgctgggtatatatccaaaggaaatgaatcattatgtagaagagatatctccactcccatgttattgtagcattattcagtagccaagacatggaattaacttgtgtccattaagagatgaatggataaatggaaagaaaatgtaatatatacatacagtggaatactatgctgccttaaaaaagaagggaattccgttatcagtatagatgaacctggaggaccttgtgttaagtgaaataagccaggcacagaaagacaaatgacacgtgatctcacttatatatgaaatctaaacaaagtcgaactcacagaagcagagaatagaatggtggttaccagggactggggagatgttggtcaaaggacacaaaatatcaattagaaggaataagttcaagaggtttatcatacaatatggtgactatagttaataacaatgtattgtattctttaaaagagtagatcttaagagttctcaccacaaaaaaaatgctaagtatgtgaggtaatacatatgctaatcagttcaatttagctattccacaatgtatacatgttttaaaacagcttgttgtacacaataagtatatataatttttgtctatttaaaaataattaaattttttaaaattattgatgtgctggatatagggagagaaagagagaaatcaagaatgactctaaggcttttggcctgaggaactaaaaggatagagctgccatcagcagaaaagggacagactataggaggagcataaattctctaccatataacttccaatattgccttcccattctctctctccctttggactctattgaagtaatgctagacagactttattcttttaaccatttattctctcttttcattctgtctctctgttgcatttttaatagtttcttctatttattttctagtttattggttctttcttcagctgtgtcaaggctgctatcaaaccattttcttaattttagtagacttttctgttctaaaatttctatttggttcttaatcaagtatatgatgtcagtagtttgtattttttagttcctaaaaacattttcaagcttacttttatattaaaatggcaaatacaattggctttggttttttaatctgataattccagcatctaaagtctttacggatccatttctggatttgtggttctgactcatgcaatcctgttccgctgttagtttcatcatcaattctgtgttgcttattattcaacctgttgttacaagatacacatttaaatataactaactcttagtcttttaataaatgttaatttttaaaagcatcgaaacttatatcctaataccagatgctgaagtctgtgaacaacttgcctgtgtaacactagatcatttatttaatctttctggatttcaagtttcttaactgtaaaaatgcaaatgattaactaccatcttctatcatttacgtgtgcagataaaagaaaagaaaaataacttgtatgtttttaggcacataataggggttttcagtatatgagtttccttttccattatcaaaagaaacaccatcagaattaaaataaaatatggaagatcaaagaaacccagagggaaaacaagaaaacaaatagttatcctttttagacaacacatctagagtacttgcgtgatatttgagagcagtatcttttagctattaacacaaattggtagggacagaatttagttccagaaatagcagatgatcctttgagacattgtactgttcaaagttatccagagaaataggaccaacaggatctatccatctatctatctatctatctatctatctatctatctatctatctatctatctatctagacaaagatttactgtaaggcattagctcatataattaatggagcctaagaagtccaaagatctgcagttggtaagctggaggtgcaggacagcctatgtgtagttccattgtaaatccaaaggcctgagaaccaaggaagttgatgctgtaaattctaatccaaaggttggcagactcgaagtcaagagccaacatttcagtccaagtctggaggcctggaaaaaaacagtgttccagctcaagaggtcaggcaggagaaattcccctttactcggcctttttgttcaattcaggtccgcaatttattgaataaggccaataacagtagggtggatgatttgctttactcagtctgccattcaaatattaatctcatccaaaaacaccttcacagatacatcccaaataatgtttagccaaatgtgtgggcatctcacggactagttaagttgaacttataaaattaaacacaacaggaatgattcattgcaagggctggtcttaactgcttttgcactaaagccagaagaaaatgctgggaactccctgcaaactgtaagccaacagcttcttgaatgttttttttctgagtattttaatacatagtataagacagtggataattaagtactaaattatttagaaaagactaagtatcttcatcttctgaatccatgagctataccattacactgataatttgattttgtactatcttgcattgttcattaactcttccagactaggttatatttttgcataaagtcatatttctctctatatagctcttagcttaatgcaatccttttaaagtaataaatgaagtaaagtagataaagcaaaacctgtgtcaatggaaaccaacacaaatgtatttaataatatgaagaaagctggtctggcttttataataattccatgatcctttcaaagaaaatccaaatgagaagcatattctagaagatatatgagtcttaagaagctggtttattcccaaaatatccttgataatataatttacaaaaaataccaattatccagtggacttggtaaaatagcagcctatgaccaagacagttttacatgctcaacctacatttcacatatgcagttacaaaatattgctgataaaaaggaaatgaggcacataaaactgcttagggaaaactgcaaaatatacttgcaatttcagattgaaataagaggactatcttcttgtcagattcccttactacatattaattattcattatgaatgtcagtttagtctataataacaacattagaaaaaatacttatagtttattttatcttttagaagaaaaatattctatgactataaaataattcatgtgcaacattacagtctagtattttaacatcaatacccagcatgtaacaaacagtttaagtataccagggaccatgatagatgcttttcagctgaagaataggactgagattacttctggctgggaattcaagaaagctgtcatggaagaggcaggagttatgaaggcctctgacagactagtaaaattcaggcatgaagaaatggctgggaagggcgttccatgagttggaagcaggttgagcaaaatgtagagagatgggaaagaggcacatttgtggaataaagaagagttcagtttgaataaaatataatattcatggaggaaatgctaagaaatggaggagtcatacacaaagactttgggctttgaaatcagaaaaccctaagctgaaattctggtatatttaacttcagtttcatcttctgtaaaacagtgcctttcacatagtgttacaaagacaaatgaggcatgtacagatacgtgtgtgtgtgtgtgtatgtgtatgtctgtgtgtgaatacattgcctgacacatagtaagtgctcaataaaattatctattactattattatcagatatatgaatataatcataatagcaaataaaactagataggtggcttgatgccttattatggaaaatcctaagtgcatcacttgcatcactaagtaatcatcaaatataagtatttaataaatcctaatctaacaattcatgaagcacaatttttacgttttggtattaagtcaagagttgacaaattttttctgtaaagggccagatggtaaatattgtaagctctgtaaggctacatgatctttgttgtaactactctactctctttgggtagcgagaaggcagccacaggaaatatataagcaaatgggtgtgtccgtattccaagaaaattttacttacaaaaacaagcagtagacaagattaagtttgttggtgataacttgtagatccctgtcttaagtacttcctatggaaatgttttcccttttatggacagacctagaagaatgttatattatacattttcatttccatattcatattatagatgaacattctcactgtgtaattaaaaactaaggttttcaatataaagctagaaatttgtcatttgtacaaaaaatggcattatatctaacaccagggcagtcctttgtacacagcaactgttcaatatatgctcattaaatagataaataaataagaccaatgaaatctttacattttaaagtaactttgttgtagtgattgtacatgactaccacttctgggagaaacagtacagaaatcataagtaaaaaagcccaagtatcctgtttcagtattttcagtgagaaagtactcactatgtaccacttgaggaagataatatttaacagtaatttaagagaattagttaataatccaaataattaacacattttactttctctagtgaaggtttgttaaaaagtaacaattctcttaaatataccgggtttgaacttccattactatcaccaacaatagtgttaaatattcaagtcttaattagccagcaactttaccagatgaaatgtgtggtagacagcctctaggatggtcccaattgagccccacctcatggtattcacacttttgtgaaattttgtcccctagggtgtgagttgaactcgttgaattgcttctaacaaagaagagatgaggccgggcacagtggctcacgcctgtaatcctagcactttgggaggccaaggtgggcggatcacaaggtcaggagatcgagaccatcctggctaacatggtgaaaccccgtctctactaaaaatacaaaaaattagccaggcgtggtggtgggtgcctgtagtcccagctactccggaggctgagccaggagaatggtgtgaacccgggaagcagagcttggagtgagccgagattgcaccactgcactccagcctgggtgacagagcgagagtccgtctcaaataaaaagaataaaaaagaaaaaaaaagaagagatgagttgtacttctgggaataggttataaaaaaagactgtggcttccgtcttgtgtgtgtcctccttctcagatctcttgcactgaggaaagcaagtaaccacattgtgaacaaccttatgcaaaggcctacgtggcatggtaaggagctgaggccctcatttcaacagcccaccagaaactgaaccttgttaacagccacgagttagcttggaagcaaatccttcagccccagtcaagccttgaaaagactgcagttctagccaacagcttgcttacagcctcccgggaaatcttgagtcagaggcatcccgctaagtccctcctagtttcctgaccctgtgagataattaatgtttgttattttcggccacaaatagcaatagataactaatatagtaaatgtttggttaacgtttataacatggccaacatgtttgtgctacaatggtgcttagactttcagccttgttttgaaggagctgactacttaatggaaaacatagaagggcaaatataattacaaaattgtgttacttatgctacaaattcagcaatatgggaacacagaagaatgagccactaaccaaatgagggggccagagcagaaagttaggttataggcagaaagagaaagtgaagaaaaaaaatgtaatagccttgaggaatgagtgccatcaagaactcaaagagggagaagcattccaggcaaagaaaacagaatatgcaacagggcagaagcatgaacgagcattatgcctttgggaagctataaatagttcagcttggctgaagcacaggatatgtgtggaaaagtgaatggagatgatgttggcaagataaagtattcagatgaaagatggaaaggtgtataaaaagaaaacaaaattgcctttgtaaaagattaaatttttctatttaggaaaaaaagtcagccacattgcatttctaaaattactttccttgaggctatgatcaaatgctactttcatctataaaaagaacagaccacaaggctatagtcactttaaaattctctgcatgcaagaggccacatctgtgtgctaaagagtagaatgattgactagcagcttcaagccaataagaactttggtcttatctacaccagagaagttctagcaaagagtcaaaaactcgaagagttagaggacatctaaaagtccaagatctcaattcaaacataaaaagcagtgcaatgaacagatggttgggagagtgtgctctctcccacctttcctttacttttgtttcctcctctttctcaacccatggcagggagatggtcttttagcataataattcaccagaggtatgctgtaattggtgagcaatattagtaggagaaatgtttccttgtcttataaattctctactctgaagaatctcaaggatttatgagaaatgcaggagtcttgtagaattttaccttcctcctcccaggatgatgccaagaatgacaattccctggccttggctagcaagactgaactagaatcctggagaactgcacagttaagaaaatgaaagagaaagggaggccatagaagatgggttccctcccaatgcttacttttatggactaaatgttaagcaatgaagaaagtaaaaaagaaagaaaatattttgcatcacatcagtaatccgtggattctctgttttactaatgcacttgtgcttcaattcttattttggctcttcaggctctcctggttttgagtcccattttaggttgtatgctttcccttttgtcttaacaacctattcttttctccggttgtactcttagtggtccctgtattcatcttctatatctttctattcattccaaaattatgtaaacacccaacctgaccaagacacaccctagcactagcccaccaggccagaacccctactaagtagccactgactctctatgaaaggaagttagaaaatgaacctgctgagagtaaagggggaaaaaggtggataggaggcaggactaacttgcagctgccactcagatggacagagcagcatgtggagacccacatcatgaacttttgctccaagaactaccataggaacataccaggaaagcagagaaaaccacagaccctttgaaggagtagattgccactgcaggctctgtgagtcagcttgctttctcagcagggaggtttgtagcctggggcaagttcttagtcctgctcataggctgcctggaaataaacggtgctgttggcagggcacagtgggaatgagactggccttttgggctgtgggctgtgtgggagttgggtgaggtctgtggctgctggctttccaccactttcctggtgacctgtgcgactcagcagaggcagccataatccccctgggatataactccattggcctgggaactgcaaccccacccccaacagtagccacagcaaaccccacccaaggagagtctgagctcagacacacctaaccctgtccccacttgatggttattgtctgctggccctggtagctgaagactaaggacataatctcttgggaactctatggccccacccacggcctgatccttcctatactactgcagctgatgtgctattgaaagcaccacctcctggcttgaggacaaccaaaacaaaaccagcgcacttaacaaaaatacaaccaaggaccctcagagagtccacttcactctcctgatacctccaccagagcaggtgctggtatggtatccacagctgagagacctgaagatgggtcaaatcacagaactctttgcagacactcccagtaccagcctggagcccagtagctccactgggaggctagattcagaagaaaaataacagtcacttcagctctcaggaagccccatccctaggggaaagggaagagcaccatatcaagagagcaccccattagacaaagaatcttaacagaagcccttgagtcctagatcttctctctgaaatagtctacccaaataagaaggaaccagaaaaaaacaattctggtaatatgacaaaacaaggttctttaacacctccaaaagaacatactggcttaccagcaatgggtcaagatcaacaggaaacctctgaattgccagaaaaagaattcagaaggtcgactactgagccaatcaaggaggcaccagaggaaggttaagtgcaacttaaagaaatcaaaaaagatgatacaggatatgaatggaaaaatctccagtgaaatagatagcataaaaaaaatcacaacttctggaaatgaaggacacacttagagaattacaaaatgcactgggaagtctcacaatagaatcaaacaagtagaagaaaaaaacttcagagcttgaaatcaaggctttcaaattaacccaatctgataaagacaaagaaaattttttttttaaaatgaacaaggcctccaagaaaatttgggattatattaaatgatcaaacctaaaactaattgatgttcccgagggagaatagaaatctaaaagtttggaaaacatatttgagggaataatagagaaaaactttcccagccttgctagagatctagacatccaaatacaaaaagctcaaaaaacacctgggaaattcatcacaaaaagatcatcgcctaggcacctgatagtcatcaggttatctaaagtcaagatgaagagctgtgaggcaaaagcatcagataacctataaaggaaaacttatcagattaacagcagatttctcagcagaaatcctacaagctagaagggattggggttctctttagcctccttaaataaaacaattatcagccaagaattttgtgtccagtgaaactaagctgcataaatgaaaaaaagatggtgtttttcagaaaaataaacgctgaatttgccactaccaagccatcactaaaagaatggctaaaaggagctctaaatttttttttaacctctaaatcttgaaacaaatcctcgaaatacaccaaaatagaatctccttaaagcacaaatctcacaggacctataaaacaacaacactatgaaaaaaaaaccaaggtattcaggcaacaaatagcatgataaacagaacagaacttcatgtcttaatattaacattgaatgtaaatggcctaaatgatccacttaaaagacacagaatggtagaatggatgagaattcactagccaagtatctgctgtcttcaagagagtcacccaacacataaggactcacataaacgtaaggtaaaggggtgaaaaaagatacttcatgcaaatagacaccaaaagcaagcaggagtagctgttcttatattagacaaaacaaactttaaagcagcagcagttaaaaaagacaaagaaggacatacataatgataaaatgactagtccaataggaaaacatcacaaacctaaatatacatgcacctaacactggaagtcccaaatttataaaacaatttctactagacctaagaaatgagatggacagcaacacaataatagtcggggacttcaatattccacagacagcagtcaggtcttcaagacagaaagtcaacaaagaactataccctagaacaaatggactaaacggatatttacagaacagatatttacagaatattctacccaacaactgcagaatatacattctactcatcagcacaggggacattctccaagatagaccatatgataggccataaaacaagtctcaacaaatttaagaaactcaaaatcatagcaagtactctctcagagcacagtggaataaaattggaactcaactccaaaagaaaccctgaaaaccatgcaaatacatagaaactgaataacctactcctgaatgattactgcataaacaatgaaatcaatatgaaaattaaaaaatttacactgaacaataatagtgacacaacctatcaaaacctctgggatacagcaaaggtggtgctaagagaaaagttcatagcatcaaatgtctacttcaaaacatctgagagcacaaatagacaatctaaagtcatatctcaagaagatagagagacaagaaccaaacccaaatctagaagaaaaaaagaaataaccaagatcggagcagaactaaatgaaattgaaaaaaaaaaaatacaaaagataaacagaaagctggttctttgaaaagataaataaaattgatagaccattagcgagactaactaagaaaagaagagagaagatccaaataagtgcaattagaaatgaaacaggagatattacaaccaatcccacagaaatacaaaagaccatttaaggttactatgaacacttttatgtgcataaactagaaaacctagaggagatggataaattcctggaaatatataaccctcctagattaaaccaggaagaaatagaaactctgaacagaccaacaacaagcagcaagattgaaatggtaattaaaaagttaccgagaaaaaaaggccaggaccagatagatacacagctaaattctctcagacattcaaagaagaattggtaccaatcctgttgatatctattccaaaagatatagaaaaagagaatcccccctaaattattctatgaagccagtatcaccataataccaaaaccaggaaaggacataacataaaaagaaaactacagaccaatatccctgattaacatagatacaaaaatcctaaacaaaatattacttaactgaatcctacagcatatcaaaaagataatccaccatgatcaactgggtttcatacaaggaatgcagggatggtttaacattcacaaatcaataaatgtgatacaccacataaacagaattaaaaacaaaaattacatgatcatctgaatagatgcagaaaaagcatttgatgaaatccagcatccctttatgattaaaaccctaagtaaaattagcataaaggtcattcgttaatgtaataaaagcatctatgacaaacccacagccgacattatactgaatggggaaaatttgaaagcattccccctgagaactggaacaagacaaggatgcccactttcaccacttctattaaacatagtactggaagtcctagccagagaaatcagataaaagaaagaaataaaggccatccaaatcaataaagaggaagttaaactgtcactgtttgctgatgacatgatcacatacctaggaaaccctaaaggcttatacaaaaagttcctagaactggtaaatgaattcagcaaagtttcaggatacaaaattaacatacacaaatcagtagccttgctatacaccaacagttttcaagctgagaatcaaatcaagaactcaaccccttttacaatagctacaaaaaaaaaaattaggaatatactcaaccaaagaggtgaaagcctgctacaaggaaaactacaaaacattgctgaaagaaatcatagattgacataaacaaatagaaacacatcccaatctcatgaatgagcagaatcaatattgtgaaaaatgaccatactgccaaaagcaatctacaaattaaatgcaattcccatcaaattaccaccatcattcttcacagaactagaaaaaacaatcctaaaattcatacggaccccaaaaagagcccacataaccaaaacaagactaagcaaaaagaacaaatccagaggcattacattactgaacttcaaactatactataaggccacagttgccaaaacagcatggtactggtataataacatatggaccaatggaactgaatagagaatccagaacccagaacccataaataaagccaaatgtttactgtcaaccagtctttgacaaagcaaacaaaaatataaagtgcataaaggacaccctatttaacaaatggtgctgggataattggcaagccacgtaaaagaatgaaactggatcctcatctctccccttaaacaaaaatcaactcaagatggattaaagacttaattctaagacctgaaaccataacaattctaggagataacattggaaaaacctttctagacattggcttaagcaaagacttcatgaccaagaacccaaaaacaaatgcaacaaaaacagagataaatagatgggacttaattaaactaaaaagcttctgcacagcaaaagaaataatcagcagagtaaacagacaacccacagagtgggagaaaatcttcacaatctacacatccaacaaaagctacaaggaactcaaacatatcagcaagaaaaaaacagtctcatcaaaaattgagttaaggacatgaatagacagttaccaaaagaagatatacaaatggccaacaaacatataaaaaaatgctcaacatcactaatgatcagggaaatgcaaatcaaaaccaaaatgagataccaccttactcctgcaagaatggccataataacaaaaaaaaaaaatggatgttaacatggatgtggtgaaaagggaacacttttacattgttgatgggaatgtaaactaataaaaccaccactgaaaacagtgtggagattcctcaaagaagtaaaagtagatctaccatttgatccaacaatcccactcctgggtacctacccagaggaaaataagtcattatacaaaaaaagatacttgcacacacatgtttatagcagcacaattcacaattgcaaaaatatagaaccagcccaaatgcccatcaatcaacgagtggataaagaaaatgtggtggatatatacatgtatatatatatatatatacacatacacacaccatggaatactacttagccataaaaaggaacaaaataatggcatttgcagcaacctggatagaactggtgaccattattctaagggaagtaactcaggaatggaaaaccaaacatatgttctcactcataagtgggagctatgctatgaggatgcaaaggcataagaatgatacaatggactttggagactcaggggaaagagtggaagggcagtgagggataaaagtctacacattgggtacagtgtacactgttcaggtgatgagtacaccaaaatctcagaaatcaccactaaagaacttattcatgtaaccaaatacgaactgtttcctaaaaacctattaaaattaaaaaaaaagaagaagaaaatgaacttgctaaatccctgaataaaatatcacagtagttggaggtgaaatgacattcattcttccacatgacagtgtaaattccagtagtattccttcacactcatttaaaaatgagtctaatctcatcagatgatgctatagtccatacttcctcatagctataatttatgaacttctttttactctcttttatttatcagagaattagcatgtatctcccaatcttgctttccacctcaagcctatcatcattttgggaactgtcagtttcctcgtacattttcaatcaatctcttgagcctgagtgttttgatttctacttacgtaatctttgctttaattctattcagattaccatgtctaaggctaacccatgtatttcattatgaacagcaactacttcatatagatatttaatctctagtaactcattctgtggatacaatgtccaatcacttcctctctcttccacactacatctattgtttaatcccatctctatccttttatccatctagtttcatccaacctatcagtccctttccatcttcacatttacttatttagtttagacacaatggcccatcacttaacaactctcttgccagtaactacattcactcttgttattttaccacatacactgagcaaaaccctattcctatttgcagttgacactttaatgtaccacccagattcaacttcagatataaaacatttattctcctagctgtatgatgtgttgctggcagacagtcttcagctgtcagctttcttttggaattgcctcaactgaagagaatggactgacccaaggccatgcccccttccaggtgcaagctgctttcaatgtcaggtcaacacaagtgtataatagtcctgtcctatcgccaacttggaatgactttgaagagtcatcccagtttcagaattccctagggagcctttggatggctatattgagacttcatcacagcctgatctctccagctgccatttctggcttccctttaacaggtgttgcctccgaaatcactcaataaatctcctgtatgctaacctacatctcaaagtcagctttctggtgaatccatcttggattgaactcagttgttctcagtggccccttctgcatctttttaaccaattaggtactaatgactgagacagaaaaatcatacaactgctagaaattaatgttatcaaatgatttgatattctctgatatggtttgtatacttgtctcctccaaatctcatgttgaaatgtgttccccactgttggagatgggcatactgggaggtgtttgcattatgggaatggatccctcatgaatggcctggtgccctccctgtggaggtcatgagttaccatgagatctggctgttaaaaagagtctaggatctacctcttctctcttgctcactctctcatcatgtgatatgccttctccccctttaccttccaccatgagtaaaggttcctgaggcctcattgtaagctgagcagatgttcatgccatgcttgaacatcctgcagaactgcaagccaaacaaacctcctttctttataaattactcagtctcaggtattcctttacagcaatacaaaatggaataacacatgctttcacaaataattcacacggtgaaaaaaataccctaatagaaaactggactaaaaactaccaacaggcacttcacaaaagaaaagtacaaataaatgtataagccttttgcctcagcttctgctcaagcctttgtataggaatgcatggatggaatacagtcttctggttttgttttgattaatatgtgaagacaagatattcacaagcttaaacattcaaatgcggcagccaagatggccgaataggaacagatccggtctacagctcccagcatgagtgacgcagaagacgggtgatttctgcatttccatctgaggtaccgggttcatctcactagggagtgccagacagtgggtgcaggacagtgggtgcagcacaccgtgcgcgagccgaagcagggcgaggcattgcctcacttgggaagtgcaagggggcagggagttccctttcctagtcaaagaaaggggtgacagatggcacctggaaaatcaggtcactcccaccctaatactgcgcttttccgacaggcttaaaaaacggtgcaccaggagattatatcctgtgcatggctcggagggtcctacgcccacggagtctcactgattgctagcacagcagtctgagatcaaactgcaaggtggcagcgaggcttggggaggggcgcccgccattgcccaggcttgcttaggtaaacaaagcagctgggaagctcgaactgggtggagcccaccacagctcaaggaggcctgcctgcctctgtaggctccacctctgggggcagggcacagacgacaaaaagacagcagtaacctctgcagacttaaatgtccctgtctgacagctttgaagagagcagtggttctcccagcacgcagctgcagatctgagaagggacagactgcctccccaagtgggtccctgacccctgacccccaagcagcctaattgggaggcaccccccagtaggggcagactgatacctcacatggccgggtactcctctgagacaaaacttccagaggaacgatcagacagcagcattcgcggttgatgaaaatccactgttctgcagtcactgctgctgatacccaggcaaacagggtctggagtggacctctagcaaactccaacagacctgcagctgagggtcctgtctgttagagggaaaactaacaaacagaaaggacatccacaccaaaaacccatctgtacatcaccatcatcaaaaaccaaaagtagataaaactacaaagatggggaaaaaacagagcagaaaaactggaaaccctaaaaagcagagcacctctcctcctccaaaggaatgcagttcctcaccagcaacagaacaaagctggacggagaatgactttgacgagttgagagaagaaggcttcagacgatcaaactactccaagctacaggaggaaattcaaagcaaaggcaaagaagttaaaaactttgaaaaaaatttagatgaatgtataactagaataaccaatacagagaagtgcttaaaggagttgatggagctgaaagccaaggctcgagaactacgtgaagaatgcagaagcctcaggagccgatgcgatcaactggaacaaagggtatcagtgatggaagatgaaatgaatgaaatgaagccagaagggaagtttagagaaaaaagaataaaaataaatgaacaaagcctccaagaaatatgggactatgtgaaaagaccaaatctacgtctgattggtgtacctgaaagtgacggggagaatggaaccaagttggaaaacactatgcaggatattatgtaggagaacttccccaatctagcaaggcaggccaacattcagattcaggaaatacagagaacaccacaaagatactcctcgagaagagcaactccaagacacataattgtcagattcaccaaagttgaaatgaaggaaaaagtgttaagggcagccagagagaaaggtcgggttacccacaaagggaagcccatcagactaacagctgaactctctgcagaaactctacaagccagaagagagtgggggccaatattcaacattcttaaagaaaagaattttcaacccagaatttcatatccagccaaactaagcttcataagtgaaggagaaataacataccttacagacaagcaaatgctgagagattttgtcaccaccaggcctgccctaaaagagctcctgaaggaagcactaaacatggaaaggaacaaccagtaccagccactgcaaaatcacgccaaattgtaaagaccatcgaggctaggaagaaactgcatcaactaacgagcaaaataaccagctaacatcataatgacaggatcaaattcaaacataacagtattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggaaggggttgcaatcctagtctctgataaaacagactttaaaccaacaaagatcaaaagagacaaagcaggccattatataatggtaaagggatcaattcaacaagaagagctaactatcctaaatatatatgcacccaatacaggagcacccagattcataaagcaagtcctaagtgacctacaaagagacttagactcccacacaataataatgggagactataacaccccactgtcaacattagacagatcaacgagacagaaagttaacaagaatacccaggaattgaacccagctctgcaccaagcagacctaatagacatctacagaactctccaccccaaatcaatatacatttttttcagcatcagaccacacctattccaaaattgaccacatagttggaagtaaagctctcctcagcaaatgtaaaaaaacagaaattataacaaactgtctctcagaccacagtgcaatcaaactagaactcaggattaagaaactcactcaaaaccactcaactacatggaaactgaacaaactgctcctgaatgactactgggtacataacgaaatgaagacagaaataaagaaggtctttgaaaccaacgaaaacaaagacacaacataccagaatctctgggacacattcaaagcagtgtgtagagggaaatttatagcactaaatgctcacgagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaataaatccaggagctggttttttgaaaggatcaacaaaattgatagaccgctagcaagactaataaagaagaaaagagagaagaatcaaatagatgcaataaaaaatgataaaggggatatcaccaccgatcccacagaaatacaaactaacatcagagaatactacaaacacctctatgcaaataaactagaaaatctagaagaaatggataaattccttgacacatacaccctcccaagactaaaccaggaagaagttgaatctatgaatagaccaataacaggagctgaaattgtggcaataatcaatagcttaccaaccaaaaagagtccaggaccagatggattcacagtcgaattctaccagaggtacaaggaggaactggtaccattccttctgaaactattccaatcaatagaaaaagagggaatccttcctaactcattttatgaggccagaatcatcctgataccaaagcctggcagagacacaaccaaaaaagagaattttagaccaatatccttgatgaacactgatgcaaaaatcctcaattaaatattggcaaacctaatccagcagcacatcaaaaatcttatccaccatgatcaagtgggcttcatccctgggatgcaaggctggttcaatatacacaaatcaataaatgtaatccagcatataaacagaaccaaagacaaaaaccaggtgattatctcaatagatgcagaaaaggcctttgacaaaattcaacaatgcttcattctaaaaactctcaataaattaggtattgatgggttgtatcgcaaaataataagagctaactatgacaaacccacagccaataccatactgaatgggcaaaaactggaagcattcccttgaaaactggcacaagacagggatgccctttctcaccactcctattcaacatagtgttggaagttctggccagggcaattaggcaggagaaggaaataaagggtattcgattaggaaaagaggaagtcaaattgtccctgttcgcagatgacatgattgtatatctagaaaaccccactgtctcagcccaaaatctccttaagctgataagcaacttcagcaaagtctcaggaaacaaaatcaatgtacaaaaatcacaagcattcttatacaccaataacagacaaacagagagccaaatcatgagtgaactcccattcacaattgcttcaaagagaataaaatacctaggaatccaacttataagggacatgaaggacctcttcaaggagaactacaaaccactgctcaatgaaataaaagaggatacaaagaaatggaagaacattccatgctcatgggtaggaagaatcaatatcgtgaaaatggcatactgcccaaggtaatttatagattcaatgccatccccatcaagctaccaatgactttcttcacataattggaaaaaactactttaaagttcatatggaagcaaaaaagagcccacatcgccaagtcaatcctaagccaaaagaacaaagctggaggcatcacggtacctgacttcaaactacactacaaggctacagtaaccaaaacagcatggtactggtaccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatgtagaaagctgaaactggatctcttccttacaccttatacaaaaattaattcaagatggattaaagacttaaacattaaacctaaaaccataaaaaccctagaagaaaatctaggcattaccattcaggacataggcatgggcaaggacttcatgtctaaaacagcaaaagcaatggcaacgaaagccaaaattgacaaatgggatctaattaaactaaagagcttctgcacagcaaaagaaactaccatcagagtgaacaggcaacctaaaaaatggaagaaaattttcgcaacctactcgtctgacaaagggctaatatccagaatctacaatgaactcaaacaaatttacaagaacaaaacaaacaaccccatcaaaaagtgggcaaaggatatgaacagacacttctcaaaagaacacatttatgcagccaaaaaacacatgaaaaaatgctcatcatcactggccatcaaagaaatgcaaatcaaaaccacaatgagataccatctcacaccagttagaatggcaatcattaaaaagtcaggaaacaacaggtgctggagaggatgtggagaaataggaacacttttacactgttggtgggactgcaaactagttcaaccattgtggaagtcagtgtggcgattcctcagggatctagaactagaaataccatttgacccagccatcccattactgggtatatacccacaggactataaatcatgctgctataaagacacatgcacacgtatgtttattgcagcactattcacaatagcaaagacttggaaccaacccaaatgtccaacaatgacagactggattaagaaaatgtggcacatatacaccatggaatactatgcagacataaaaaaggatgagttcatgtcctttgtagggacatggatgaaattggaaatcatcattctcagtaaactatcgcaaggacaaaaaaccaaacaccacatgttctcactcataggtgggaactgaacaatgagaacacatggacacaggaaggggaacatcacactctggggactgttgtggggtggggggaggggggagggatagcattgggagatatacctaatgccaaatgacgagttggtgggtgcagcacaccagcatggcacatgtatacatatgtaactaatctgcacattgtgcacacgtaccctaaaacttaaagtataataataataaaatttaaaaaaaaattcaaatgtttcctcttttacctcattatgatttctttcaaggcagacacaatgtgtctaatttgtctttatatcaccattacacattacagtagaattcactttattaggagtcaggactcaatttttgaacagtcagagtattacggacaaaacaatatttcatgtatttttaaacaaagtatttcacatcatttacttaatatctatatttgttaaatactgatgagaacaaaatttcaagtatctagaatttagcaaagaagttaaatgtccaactaaaataagtttaaatttaaatgattaaattgtttgttgtatttcagattctatccattttactttaatagaaaaatatcattcataaaaaagtttggctggccacagtgactgacaccaaaaatcaaagcattttgggagactgaggtaggaggattgcttgaggccaggagttccagacaagcctgggcaacataggagacccccgtatcttcaaaaataaacaaattagtgggatttggtggtacaggcctacagtcccaacttctcaggagactgaggcaggagaatcacttgagctcaggagttttaggcggccgtgagttatgattatcccactgcactccagcctaggtaacagagactctgtctctaataataataataataataataataaagttttcatgaaaaaaagaaatattaataaaatttcctaaattggagacatgcactcattatccacatatatcaacattggtcttattttcattatggtatactgtatgagctatggaaattattaagtatcaagcattaaattacctgccaattcttgttcattatacaatcactggtctcagaagaacataatcattacaaagacaacttcaaaagtaggagtgactatctttaatgctttaatgacattgtagagcatcacatcatgatttgttatggagtttagttttcctcttaattactatcacacttcaatctaaatgaatttagatttcatgtaacattttgactttttggaaggtcatggtttcttcattagtaggcaaaactcctacttaggaaagctatcaattcctcaattctcctattatttttatacatgtggttatagtttaatagattacttcttttatatgcccactgcagcatgtgaattttatgctaacaagagtgtgcacttaggcacacatgcaatatagctatgatatgtctatcatataaattaaatatgtgccaagtatttcatggagctaatacattttactcaaaatgtcagtaaattctagaaaaactggatggaaattgccaattataaaatgagagttttgattgaagtccacattagccaggaacccatactttggttacctgatattttggcataaatgtgaccacatattcatcttactatattattaccatatgaacatatatttcctttgaaatgctatcatgttcttcaagttatatgaatactaatgataagagatcttacatgttataaaaggaatacattgtatggaattacaatttatttagacatactttgggaaaagtttgattgcatttcatatgcgttcataaatcaaattgaactgtttcaggattttcaggaagcaaaatgacaaccaaaagtataatttaatcctaaagcatctttcctctttttttcttaatactcacagctaaacttaactgaaagtaaagttttcattctaagctttccaggttcattaaattgttcctatatcctcacaaaatcatgatttttgtttaaaatttaaggacatttttgttgttgttaacaaaatattgcttaaatacttgttatacatcatatatatttatgagtccaaaagtacctagttattataactttggaagcccagagtcctgtttaaaaaaaaaattagatgtcacaaaaggcctctgagctcttgatgaatgtgttataagttttgtgtacatcttaagggacctctttcacaagcaaccagaagtccttttgtaattacttatgctcaacatctatttctaatttgcagagctatgatgaggaacatccccagttcacacaccacttggcaactctgaactcactgatcaatgtgtcagtagacaggtttgtaatgagtagacataaaacaacatatcacatatgcgtgcacacacacacacacacacacatacacacgctctttaaagtgctttgaagtgtttactctttggtctgctactcatggaccaaatattattaaaaaatatgttgctgctactcttccaaatatacttaaaactctgacatgtaatgcaggttttcctataatctgtgaaatccctgctgcctttcaaaaaaatcattctaataaaaacagagataaatttacccagaagagtaaactagcatgaaatgccctgtttttgctgttgtcacaattcattgttaagttatttagtggtcccttattaaatgcccttagaattcgtagtgcaaaacgtttttacatagaatgggagtcctatatgacatattttaatttttacatggaatgacattcctatataacaaattttaatcctgttaatttaactaattacataaacctaaccaccacagtaaattatagtctgacctaaaagaaaatatggcatgagctgagacaaaatgtatccagttctcagaacatatctatgtctcctctaatttgtaggtcttttttcctttgtatgacactccacttaaatatcctgccggacctagctcaaatgctattttttctgcagcgtcttctctggctcggtcagtcagtaactgatgtttcttccatcatttcttcatataagatcaggctcattacattataattatttaggtatccctctgtctccctacagagcgtgagctccttgaaggcaagaacctttttacattttctttacactctcagacctaagtatagtactggatgttaaattaataaatacatgcaagatactatatcaactaaattagatatttcaaaatagttttgttgttgtaacaaaaattggatgttttgtagatgtttataattctgttttcattttaactaatacatagagttccactttattaaaacatatcctttgattaccttatagctagacacagaaggaggaaaataggagggtaaaggattttaaaagcatttggggatttttaaaaaaggcttccagagactaataaatcactgaacagtagtaacaatgctgtcatcaccaatctctatacaccgagtttcatgcagcatttaagaaagcctatgagttaaactgcgcttaaaataagatatatatttgcttttaaccatgtcaaattgtgcatgaaaagaaagtccttgaaggcactataccaaatgttataaagctcacctctggctggagagattatggattaattttttaaaatatttttcctatttccctaatattcttctaagagcatgtcttactttgatttacttatatttgtttcaaatattggctattattttttaaagcattacagatacttttaaaatctcttttatatcctgtcacaaacctatttccatgttgccttcatgagttaatcaccatcctgaagttggtatgtattatccgtctgtgcctttatacttttactatttatgtatatagtcattagacatattaattatgtcacagacatattgtgttttaaatttacattaatatcatatgacaattctgactcctttttttcatttaacactttcaatatagatccacatggatgtttataatcctactgttttattttaactaatacatagtgttccattttattaaaatttatcttttgattattttatgaatagacattttgttttttcgtaatttttcattcttacaaacaatattgcagtgaatatccgtgagagacttaaagttttcttttcaagagccatacctagtagtacaattaattgatagatagaagagtatgtgcatttcaaacttttaaaaatattgatgaattgtcatccaatgtggagtaccaatttatagtcctatgagaattcctgtttttctatatcctttacaatacttgatattgtcagaactcttgttttctgtctttctagtagatggaaatacaactggcacctcattggggccttaatttaaatgtccctgttacctgtgttaactatgtttattggttattcaaaattcattttcagggaattgtctttgccaattgtttccattctttgtttgctttttgttgttgtcttttccttactttgtagtgcttataccttctcagtatgtgcattataaacatctttcccagtttgtggcattttaaaagtattttgtgacatgtcatgctaagcatgagctttaatgtaatcaatcctaccaatcttcttaatgatgtgtactttttgtcttgtgtaagaaatccttccctaaactaagatgtccatgtggattactttttttaatttgttaaattgaggaattatattgaaagatttttggtggctgaaatatccttagaagagtgagttaagttctacttagtatgatctacgttttaatgcattattgaattcaatgtggtaatattttgcttagacttagtacatctgttttcacgcagagattaatccatatatactgttcttgtactctccttgtccattttcgtatgtaagtcatgaaagtacaaagttgggtagtttacttctttgtacactctcttcaacagtttgtatagcattggtattatctgttcattaaggtttgataaaactatcttatcaaaccattttgcaattctattctgttaaaatttactgagttatgactagtaattagtacttttcccagaaaattgtacattttatgtcttaaaatataaagaagaaattaataaaatcaagtatatcagtggttacattaaatataagtagaattatccccaataaaaaccaaacatggggctaaaaagttagacacatttttttaaaaaagttctatcctgctcattagaaatacacctaaaataaaataaagctggaaataaatagaaaagaagtgaaaagcaaaggcaaacaaaataacagaaatgaaaatattaaaatatataaggtcatattttagaattaaaattgttaatagaaataaagggaatactatataatgacaaacatgaagaaatttataaagcaattgtggtatcattctaggagtaaaatcctggaaactattttatctgaaacagaaaccagactcaaatgccttccattgccatttgttcaacattgtcttgaaggttctactaaatatatcaaagtgggaaattaaataattactataaatattggggaaaagagtgaaaatatttatttttgttgattacatgattatatatccaaaagcctctataaaactcaaaagccggctgggtggggtggctcatgcctgtaatccaagcacactggtaggccgaggtgggcagataattttaggtcaggagtttgagatcagcctggccaacatggtgaaatgccatctgtactaaaaatacaaaaaaaaaaaattagctaggcatggtggcacacacctgtaatcccagctacttgggaggctgaggcaggagaatcacttgaacccaggaaacagaggtttgcagtgagccgagatcacaccactgcactccagcctgggtgacagagtcagactctgtttcaaaaaaaaaagaaaaaaaaaaaacctcaaaagcttaagttttaaagtaaaatatattaaaattaaaataattttgtaaggtagctgaatacaactaatatattaaaaattcaatacttattgtgcattctaacaataaacacctataaatggaaatgggaaaaaaaattctttcaacagagtgataaaaactatcaaatagaaactactaagaaattcatagaaattgtatcatttaaaaaactatatattttattaaatgtcatgtaaaatctgaataaatctaggacaatataaaatattaaaagggcaattccccaaaagtaatataaacataaaattaaattccatttttttataattccatttttttggatgtagttcttttgaaattggatgaaattatcttaaaactcatatggtaaaataaatgaccaaaataacaaagaaagtatgaaaaataatagttaaaaaaagaatgcctgtccaaatagcagaaaagattatacagctactgtaattacattaatcagtcatataaaaaatgaagagcaataaaaatatgtccaaatatatagaattttataaataacaaagagtgtatgtgagtaggaaaaggaaagcttgtttaattaataatcataacacaaatgaaagaaagtaaatttaaacccctattgtaacacagtattaaaaaatccagatggattacagaattgattttaaacaataaaacaataataatcttaaaataaattataggagttcattagtatagcctgggataagggagaattcttaatcaagacaagaaacctagaagaaagaaagaaaaagattgatatatttcattacataaaaattgaaggccaggtgcggcagttcacgcctgtaatcccagcactttgagaggctgaggcaagcggattacttgaggtcaggagttcaaggccaccctggccaacatggtgaaatcccatctctactaaaaatagaaaaattagctacacatggtggcacacgcttgtaatcccagctacttgggaggctaaggcgggagaattgcttgaacctgggaggtgcaggttgcagtgagcagagattgccactgcactccagcctggacaacagagagagactctgtctcaaaaataaaataataaaataaaaattgaaaagatatcacaattaatcatcagaaaaatgacaaattgagaaagaatagttgtactacatataacagattaagggttaataactgtgatctataaagtgataaaatagtataaaattgggcaatttatatgaatagcaattcagagaaaagcaaatctaaattatcaacaactatttgaaaaggagcttgaactaatagtagctgaggaagtactaattcaaataaaaatgtgatatctattttgcactatcttcactggaagaattaaaatgtagaagaataaagattatattagctatctatttctgtgtaacaaattaccccaaaacttaaaaccgcaaatgtttattatcttgcagttttcatggctgagggtctaggtatggctctgctgactcagggtctcgaaggctgcaattaacgtgtcaattgggcctatggtctcatctgaggcttgactgggagaaattgacttcaaagaccactcacatggttgttggcagcattcagctcccacaggactgttgggttgagggcctcagtttcccactggctgttaatccaaggcctccctcagttccttgtcccatgggcctctccacggaacacaaagtgctccatcaaaatgagtgaaccagacagcaggagagagctaataaaacagaagccagaggtctttgtaacctgatctcagaagtgacatgcattattctttccatattctattcattagaagcaaattactcagtccagtctatacataaagggaagagattaaacaaaggcataaataccaggaaagcggatcactggcagttatcttagaggcttcatatggcagttgtggagaaaaagactgcaggctaacattgttggtggcaatggaaactgatacagctgttttggaaagcaatggcattaagatcagtccctccgcatctcattcagaggtcactttggtttgctaggttatttcccgattttacaactgcaagcccacatcctggaaatcccttcagtcctaggcaaaccagcttggtttgtcagcctactctagagccagactgtctgggtttaaatcatggctccatacttaactagcaatgccaccttgagtaagttacttaatttctctatgtctcagcttccttatttgtaaaataagcatgataatatcatgtttgtgggaaactgagacagtacctgtaaagtgcttaaagcaatgtctggcacattaaaaattctcaatgatatccattgttactatcatagatattaaaatatatgtatcctttcactaaggtatacaaacatttatcatccaaactgggaaacttttgagagtgaaaaggagtgctagtaataattatgccaggtcataaacaggaatattccagggagacttggatgtatgattaacttacatttgacccacagggaaatttctctcatagaaataaaggcacctcagtataagggaagtacacagtgatgtttgttgcagttttgtacttagtggaaaataaaaaagtaattcaaaattaagtgaatgctcaccagtagacaaagaataaatcacaatacataatgtttttaaatattatgcaacacttaaaacaatgaaatacagtgacaccaactgacttgaagaagttctttgaaatatctttgagtaaggaaagtaatatgcacaaaagtacaaatagttccatttgtaaaacaaaaggtttacactcagaggcaaatattgcagcttaagcttcagggtccagctctttcataggcccctcccaagatgttgagaggggtctagaaatgtttcctcatggttacatgtttttgtaaattatgcaaaagtaaaatattttaattgcaataggttaatacctctgtttctttcacctttaatttccctatcatatttctctgtattttgggtagtatttgaatggctgcagacatttttggaatccagctaaaggaaagatgaatcttgggcacatttagtttgggtttagtaatatatatttatgaattctgaagtcactcccatgtacatacagttcagatgtaagaatggcttctaggaatacccctaccacctcctgtgccaactcatcgggtatgcaacagaaagttttaaagccatattttgatatgggtgtgacctatgatgttcggtaccagaaatatttgtgtagtgagtgagaaagatttgaaatgtacagaactagccagtggaaaattcttccaaatcttcaagcttggaagtgaaagaaggattttatcaaagttgacaacaatccccaaaatcagcgtgacagtaccaataaccgattgtgaagctgaaataaactttctaacaaacaatgataaaacattaattttgatcaatcatgctagaggaaagaccgaattacccttttattttctctatcagagcattcttcaacagaaatagcgtgagccacatatgtaactttaaattttctaatacccatattaaaactttttaaataggtaaaatttaatgtttatttgacccaatttacttaaaatattagtatttcaaaacaaaaattactaataaaatattttacattctttttgtgtactatgtcttcataatcagatgtgcaatttatacttttagcacatgtcaattcagacagtaaactttaattgaaaatacacaatctatatttagactttgtagaattacagttgaaaaagtggattcatataaccaagtttttctaaacataaagttttcaaataactgaattgaacaccaaaaatcattttcctttaatatttggacctatgttgataaaactggttcattacttttaaaagaattaagttgactttgaaatataaccatttcaactttaaaattatgtctgcccaagtttaagtaaattctctgactcagcaatattaatagaaaagtcaaaggggtattgcataaattttaaaacagctctaaatttatcaacattaataaagctttcttcaaatttgttttgtttttgcaatacatttccataatgctattgaccatcaatggatggatggatacagaaaatgtggcatgtatatacaatggaatactgttgagccttaataaaagaagaaaattctgccatttgtgacagtatggatgaacctgggggacattatgctaagttaaacaaaccaggcacagtaagacaaatactgcatgacctcacttgtatgtggaatctagaaaagtcaaactcatataagcagggagtagaataatggttaccagacgttggagaggtgggtggaaggagaaaggcagaatgttagtcgaaaggagaatgttagtctaagttgcagttagaggagaggattaagctttagggatctattgcacagtatggtgactatagttaatacattgtatatttcaaaattgctaaaaaatagattttaaattttaaatgttctcactacaaataaatagtaggtatgtgaggtgatggatatgttaattagtttgatttatccattccattatgtatacatatatcaaaacattacactgtatcccataaatatatacacctattatttgtcaattaaagatcaatttaaaaatgaaaaatttaaaaaaatacatagatgactaggacatagagtataccctataagagagagacataaataacatgcatgtattttaaatattcaaaaattttttcatattgattcatattaatgtgtaaaataattatattgatttgttttatgaaaagctctgtttcaacacaactctttgtgtccttctcactaataagctcttcctttccttggagcttcaaacttagcttcttcatgtgtagtgtgatatcaagaaaatgtaggcacattgccatttctttacttactaagaaaagatatttttaatatacttcaaactgtgcaataaatcaataaaggaatttttttgttttaaaagtcaaaaaatctggatttttgatctaatataacaggaataccacatgttgtgatagatactaatgttttcacatttagtagaaattatttctttgatgtaaattttaaaaatctatttcatgagtttgattatttaggctatgagttgaaaatattttttaatttagcaaatctgaaggttgagagaaagcatactcaaagtgttaattaggcagtgtctcatgtcacatgacttacctatagctaatgaaaaatatctgcaattaaacatgttcttaataagttacatatgacattatttaggaaggtttttgtattcaatgaacagttgtttggtggtttaattgaagagcttttggttgtttttggcaaaatatcttcattagttttttcctcaaattttctagcaaaattttcattactgaaattacttcttttaccagatctcacttaaaatgttcttccctttgtttggaacctaatccattttatagctggcaaaaattacaagctcaaatccttccaaaaattgtttttatattttgtgttggatatttaattttgattcaggcaaataattttcactgatttttttttttactgttaagagcaaatgtctttttttaaaaaaaaattcaatagcttttgaggtataagtggttttatgttacacgcatgaattatatagtggtgaattctgagatttttgtgcacccatcacccatgtagtctacattgtacctaatgtgtagtttgtttttttatccctagctaccctctcaccctcctgcttctgagtccattatatcactctatgatgcctttgctgacacatggcttacctcccatttataactgagaacatatggtttttggtttcacactcctgtgttacctcacttagaataatggcctctagcttcatgcaaattgatgcaaaatacattattttgttccttttaatggctgagtagtattccatggcatatatatactacattttatatactacattttctttatccactcattagttgatgtgcacttagcttgcttccacatctttgcaattgtgaattgtgctgctataaacatatgtgtgccagtatctttttcatataatgacttcttttcctttgggtagacctagtagtaggattgctgtatccattggtagatctacatttagctctttaaggaacctccatactgttttccacaaaggttgtactaatttacattctcaccagcagtgaataggtgttcccctttccccacatccacaccaacatttgttgtttgactttttagtaatggccattcttgcaggagtaaggtggtttgaatttgcatttccctgattagtgatgctgaacatttttttcatatgtttattagctatttgtatatctccttttgagaaatgtctattcatattccttgtcaagtttttgaaggaattatttgcgggttttttgttttttgttttttctgatttgagttccttgtagattctggatactagtcctttgtcggatgcacagtttgcaaatattttctcccattctgtgggttgactgtttactctgataattatttattttgctatgctaaagtgttttagtttaattaggtcccatttacttttgtttttgttgcatttgcttttggggtcttagtcatgaattctctgccttggctgatgtctacataagatttttcaacatcgtcttccagaatttttacagtttcatgtcatatatttaagtctttgatccatcttgagttgatttttatatgtggtgagagatagggaaccagtttcattcttctacatgtggcttgccagttttcccagcaccatttattaaatagggtgtccattcccaaatttatgtatttgtctgctttgtcaaaatcacttggctgtatgtatttggctttatttctgggttctctattctgttccatttgtctatgtgcctacttttataccagtatcatgctgttttggtaattatagcattgcagtataatttgaagtctggtaatgtgatgcctccagatttgttctttttgcttagggtcactttggctatttgggctccttttgtggttccatatgaattttagaatggttttttataattctgtgaaaaataatgttggtattttgatgggaattgcattgaatctatgaattgctttgggcagtatggtcatttttccatgagcatggggtgagttttcatttgtttgtgtcatctatgattactttcagcagtgttttgtagttttccttgtagagatctttcaccttcttggttaagtatgttcctaggtatttttatttttttgcagctgttgtaaaagggattgagttattgatttgattctcagtgtgatcattgttggtgtatagcagtgctatggatttgtgtacactgattttgtaacctgagaatttactgaatttgtttatcaaatccaggagtcttttggagagtttttagaatattctaaatataaaatatcatctgcaaacagcaatagtttgacttctatttgaatgccttttatttctttatcttgcttaattgctctggctaggacttccaggaatatgctgaaaaggtatggtggaagtaggcaagcttgttttgttcctgttctcggtggggggaatgctttcaactttttcccattccatatgatgttggctgtgggtaggtcatatatagcttttattattttgagataggtcccttctatgcctcatttgttgagagtttttatcacaaaagtatgctggattttgtcaaatgctttttctgcatctattgagatgatcatatcatttttgtttttaattctgttaatgtaatgtatcacacttattgacttgcatatgttaaaccatccctgcatccctgggaggaaacccacttgatcatgatgaattatctttttgatgtgctggatttggttagctagtattttgttcaggatttttgcatctacgttcatcagggtaattagtctatagttttcttttttttgttgtgtccttcctggtttgggcatcaggctgatactggcttcatagaatgatttaggaaggattccctctttcttaaccttttggaagtttcagtaggattggtaccaattctctttttaatgaatgtctggtagaattcagctgtgaatccatctggtcctgggcttttttgttgttggcaattttaaaattatggattcaatccactgcttgtttttggtgtctttatggtttctatttcttcttgatttaatctatgagtggtgtatgtttccaggaattgacccatttcctctaggttttctagttcatgtgtgtataggtgttcacagtagcatccaatgatcttttgtatttttgtggtattggttgtaatgtatccagtttcatttctaattgagcttatttgaatcttctctcttcctcacctggttaatctagctaatgatctatctattttgtttatttttcaaagaatcagctttttatttcattaatctcttatatttatttgtttgaatttcatttacttttgctttgatctttgttatcttttttcttctgctagctttgggtttagtttgttcttgtttctctagtcccttgagatacaacataaggttgttaaaatttgtgcccttccagtttttgatgtgggcattgagcactataaactttcctttagcactgctgttgctgtatcccagagaatttgataacttatttcattattatcattcaattcaaataatttttaaagttccatcttaatttcattgttagctcagatatcattgaggagcaggttatttaatttccatgcgtttttatagttttgagggttcctttttgagttgatttctggttttattttgctgtggtttgagaagacacttatgatttcgatttttaaaaatttattgaggcttcttttctggcctgtcatatggtctatcttgaagaatgttacgtgctgatgagaagaatgtatattctattgttctagggtaaaatgttctgtaaatatctgctaagtacatttgttgtattatgccatttaagtccaccgtttctttgttgattttacgtctcaaagatctgtctagtggtgtcagtggtaaattaaaatcttccactattgttatgttgctatctcattttttaggtctagtagtaatgtttcataaatctgggagctccagtgttaggtgtatatatatttaggatggtaatatctttttgctgggttgacccttttatcattatatagtgaccgtctttgtgtgtgtgtgtgtgtttttttttttttttttttaccattggtgctttgaagtcagttttgtttgatataagactagctactcctgcttgcttttgtttccgtttgtgtggaatatctttttccacccttttgccctcagtttatatgaatccttccacaaggattcatataatgaatctcctgaagacagccaatatttggattgtgatattttaaaatccattctgccattctgtaccttttaagtggagcatttaggccatttacattcaacgttaatattgagatgtgagattctgttctcttcatcatagtaatttttacttagtttttttcattatgtcattgttttataggccttgtgagttttaagctttccaaaggttcgattttgatacatattgggcttttcttcaacgtttagaacaccttttagcacttcttgtagtgctggtttggtaatgacaaattccctcaagatctgtctgaaaatcactttatttcttcttcatttgtgaaacttagttttgtgggatataaaattcttggctgacagttgttctgtttaagaaggttgaagataggaccccacacctctctggcttgtcaggtttctgctgttagtctgataggttttcctttgtacgttacctgatgtttttgtcttactgctcttggaattctttgcttcatgtttactttagataacctgatgactatatgccttggtaaatatctttttgcaataaatttaccaagagttatttgagcttcttgaatttgatatctagatctctagctagaccagggaagttttcctcaattattccctcaaataagttttcctcaattattccctcaaataagttttccagacttaatattttctcttctctctcagaaatgccaattattcttaggtttggtcattttccataatcccatatttcttgaagactgtattcatttcttttgattcttttttctttattttgtctgactgggttaattcaaaggccctgtctttgagctctggaattctttcttctatttgttctagtctattgttaaaactttccactgcattttgtaacgccctaagtgtatctttcatttccagaagttcggattgctttttctggatgatatctatctctctagaaaatgtttcagtcatatcctgaactgctttaatttctctatgagggttttcatcattctctaatatctccctgagtagcttaataatcaaccttctgaattacttatgtggcatttcaaagatttcatcttggtttggatccattgctggagagctagtgtgatctttcagagatgttatagaatcctgttttgtcatattaccagagttacctttctgattccttctcatttgggtagactattccttctaattattcttaaatttatgtttgatttgactgtgtttttttttaatattccttttttcccctaaaagatgtgactttaatgcttatagttaattattgcctaacttagttcttggtactttcaggggtgaagactctgtaagatttccttggttatagtctttgcatgatggctttctcatatgctggttatattaagaacgttctcagtgtgtgagcaagttcactgtttactatggggttggaatggcagaggtctcttgatgcttatctcattcttccatggcatgtgcttatttatttatttatttatttatttatttatttatttatttttccccagtattttatttgctggtttgatggttcaggcttcaggccaataggggaggtgtcccttgacaggaaccagctgtggctaaagcaagtaggtaaatgcaatacccaatggtgggtagaggtcccagccttgacagaggtggctggaggagctcacagtgatttgcactaaggtcttatcaaggggaagagttgcagttacctcagctcccctgtcaggtcagcaggaaagttatccacctctcagacacactcctgtcctagtgctctggctatgcagatcggataggcacctcttttcatctgtaggaatgttgatactccatgtagaaagcaagtgactctgtgtcttatgcaaccctgaccctgtagggtgctcctcctgtggggatgcagtaaccctgacatgtttcagaaaggctgtctattgttgtacccatgctgagttcccatgggagaagccccaactgtgcctgccatggtggacaaggggggaatgacatctccttctccaaggcctatcaaatgcaccagggctgattgttgggttagagctgaagaatttccctgctgaacccagcactggaactgtgcttctgctgaaggaaacttcatatcagcagaaagatctggtgctcaaggcctgccatccaggtccttctgaaccacagggtattcccttgatttggtacactcccccttctcctaggaggtgggaatcctggaagctagactattatgaatgttgttgaagagtgaatttcttatcaaatttactatgtatttgtgaaatatacctcttactatttcccacttaattatctttaaagttttgttagacaacaaacagctgtttcagtttcctctgcattggcaaattacaattaccatcatcatgacatagacatgcttttctatgtttgtatattaaaggatatatactgagctttgagcattgcttaaaatgaaggtgagctgaagagtgggaacaattgggtcaggcaaaatgtgagacttgattagcattgcctatataaagttaggcattgtttacaggttttaattcagtgctacaagcatgtatgtctttagtaatttataagacattcaatatgggggggggacatttttcaaatataatgtgatttatattttttattgttgattcatatttcattatattatgatttcagattgtgacttatttctctgatgtgttgaaattgccacaatgacctaataagtggtcaatttttctcagggttttatgtgtgcttgaaaagaatatatatattctgtattgatgggcacaaagtcctagatatgtctattaaatcaagcttattaattctattattcaatagttctaatattatatttcttcatttgtcaatattctgaatgaaacatgacatattaaaatcttgcaaatattgtagatttctgtttctcaaaatcctatcagttttggcttttaatgtttcaaggctgtgttgtgtattgttgtatgtaaaaaaaattacggctatgatatcttcttggtattgtgctttctgtggtttgattcttttaatattataaagtattcctctttatcctttttaatgtttttagccttcaattaaattttgactaatgatagtcctgcaatgcctttctttatgttggttttgcttgatctttcctattttaacccaattctttcaaactttctgtgtcactttgatttaggttttactcttataaaaaagcatatagcaagaattttaaaaattgcatgcaatataatctctttgtctttcattagttatcttctccttcgcatttttggtttgccatgtttcttctttgcttcactcttttttccaagaactagggacattttaattaataaattgttgctttattcttttagtcttcattattggtttcgaagatatattttcctaatttttagtggtttctcttaaaatttttaccagaaatgttttttaacaaaaataaaaattattaagtacctttgtttctctagttctttagcaaacctctatcttgcttgtttttattgtctggaaatttaatatgcccagctgctcattctcagcagaggggcagactttctggccctagctccagtgaagctcttttagactccattaccattaagaatgcaatctccccactgctctgcccactgctggaccaagtcacgagctgggctgctattcaagtcccactttctattttgtgcttctgatccagttgagcatcaagatattttctttgcttttcagcacaagtaacgtttataattttctgtttttctattttttctttcattattgtttggaacactgggcaggagaaaataggggaaggattgctttaacaaaaacttgacagatcttgccatgatgacagagccattatacttctataataagaaaaatgtttaaattaattaaaaaatgaatacagtacaaacgcaatcccagaactttgggaggcgaggtgggcaaatcataacatcaggagtttgagaccagtctgaccaacatggtgaaaccccaactctactaaaaatacaaaaattagctaggcatggtggcacgcacctataatcccagctactcaggaggctgaggcaggagaatcacttgaacccgggaggcggaggtggcagtgagcggagatgacgccattgcactccagcctgggtgatagagcaagactccatctcagaaaaaaaaaaaaaaaaaagtacccacaaatgtatatacaccaaatgttcacattgatataaaaactatgcacagcaaagaaagaaaatacatcagaatattaaattagttgctgcaataagtatgatacggggaaagtacttttattctttttactttctatatattgaacaaaatttagtaaaactttattctattttataatgagaatacatatttttgagctactagaagagaaaagaagcattatattagtagctatgctaaaaattttaaagtaatacaatccaacagcaattaaaaggtaggcattttaagtcagctcataccttcagaaaggtatgccaccgtatctcaagatttacacaaatcacttttacacacgtggttatagtaaccaaagtatgcttcagttgaaatgataatccagcatcctcatagatgcctgtgactaaaggtcagttagtttcaaaaggaatggagtgcttagctgattcaatgctctcgacttgtttacggcatagcttttagcattccattattctctttttattgcctttatgcacaggtgaaaaacacagaaaacactagatgattatttggtaataaattgaatggttctatggaaatgaaaagcatagaaaacctatgtgattaaatggcaactgcagtttttctctggattctgcatataaatagaataggttctcccacagagaatgagcctggctaaatctgatagttaaatatacagctctggatgtaataatagtctttgaaccttcttgaatcccagtatctagagtgctttaagctattattttgccaagtactgtagataaagcctctctgttaccctatgtttaatatgtctttgttgtctttgtgtcttacacacctagttgacctggaaaatagtatgtcctcaacaaacgtttgtggaacaaatgaattggtggatagatggattaatgaatgaatgattttatgaaaagagatggttctgaacagtaaaaggaaacactgaattatttgaataatgcactgagaactacagtgatttctcaatgccagatttgcttctgaattcttatctccttcaacaaactattcccctattctgttttagtttccacaactgcaatatgacatctgatgataaatgtgatgaaatcacagatctggatatattttgtacattatttattgactgagattaaataacaaaattatttttaattctctatttttctaaattattcaaacctcatctgttaatacccaaaaataacacctaagaataacctagttttctcttttccctttttgtataaattgcctctgaaaggccaattgaagaactattatgagcttcttgaatttgtgtgttctaatataaacataaaatgtaatctattagataaaatctagaatacaatataatcaaggtaaaattgttactttttaaacatacagtgtgactgtattgtatgtcagttagttgtgttaatgttacttagagtctaggactatgtaaagacagaactagtagtcttcatataatactaaatgaaaagaaaatgaattagtaagtctgcagtagatatatctgacaagtctagaaaatgcaggtaaggtgaatagttaaatatgagactacaagcattacgtaagattgtaagatttctacaagattatattttcagtataaaactatttcccaattaatgttgtatgcagcagctgctaaatagagcaaagttactgagtgattccatgaagtaagagcttaaggctgggcgtagtggctcacgcctgtaaacccagcactttgggaggccgaggcaggcggatcatgagatcaggagatggagaccatagtgaaaccccatctctattaaaaatacaaaaaattagctgggcgcagtggtgggtgcctgtagtcccagctactggggaggctgaagcaggagaatggcgtgaacctgggaggcggagcttgcagtgagctgacataacgccactgcactccagcctgggcgacagagcaaggctccatctcagaaaaaaaaaaaagcttaattgttagtatgtgctgaaattacacaattgtgagttccaagagctataatgatattgcctcttttttaatttttattttagtttcaaggctacattttcagatttgttatataggtaaactcgtgtcacaagggtttgttgtacagattttttaatcactcaagtactaaacctagtatccaatacttatttattctgatcctcaccctcttcccaccctccacccacaagtaggccccagggtctgttgttcccttcctggtgtccatcatttagcacccaattttaagtgagaacttctcacttaaatgatgatgagcacttctcatcatttagcacccaattttaagtgagaacatgcagtatttggttttctgttcctgtgttagtttgctaaggattacagcctctagctccaaggctcaaaaaataaactcaaaatcatgcaattacatggaaattaaacaacctgctcctgaacgacttttgggtaactaataaaattaaggcagaaatcaagatgttctttgaaactaatgagagcaaagatacaacataccagaatctctggaacacagctaaggcagtgttaagagggaaatttatagcattaaatgcccacatcaaaaatttagaaagatctcaaattaacaacctaacatcacaactaaaagaactagagaaccaagggcacccccaaagctagcagaagacaagaaataactgaaatcagagctgaaatgaaggatatcaagacatgaaaaaccgttcaaaagagcaacaaatccaggagctgatttgttaaaaaaattaataagataggccactagttaaactaataaagaagaaaagagagaaggtctaaataaacacaatcagacatgacaaagaggatgttaccactgaccccacagaaatgcaaataaccatgagaggcaactatgaacatctctatgcacataaacgagaaaacctagaagagatggatgaatttctggacacatacactcttccaagactaacccaggaaggaactgattccctaaacagcccaataacaagctccaaaattgaattaggaataaatagcctaacaaccaaaaaaagcctatgactagactgattcacagccaatttctacccaatatacaaagaagagctggtaccatttctactgaaactatttcaaaaaattgataagggactccttgcgacctcatcctatgaggccagcatcatcctgatactaaaacctgccagaagcacaataaaaacaagaaacttcaggccaatatacttgattaacattgatgcaaaaatcctcaacaaaatacttgcaaacttaatccagtaacagaccaaaaagctaatccaccacaatcaattaagcttcatccctgggatgcaaggtaggttcaacatacacaaatcaataaatgtgattcatcacataaacagaactaaagacaaaaaacacatgattatctcaatagatgcagaaaaggctttcaataaaattcaacataaaacctctcaataaactaggtattgaaggcacagacctcaaaataataagagccatatatgacaaacccacagccaacatcatactgaatgagcaaaagctggaagcattccccttgaaaactggcacaagataggatgccttctctcaccactcctatttcacgtagtattggaagtcctggccagatcaatcaagcgagagacagaaataaagggcatccaaacagaaatagaggaagtcacactatccctgtttgcagacaatattgcctctttcaggagcattgaaaataactcttgtcagggtttcaactgcacactagccaggataatctaaatttaaatattacaatgtataagcaaaaatagtagttaaaaatctgtatctttagcagatgcaaggttattgcagaagtttaaggagggtgatgcaatcagatttgtggttttaagattactttgactgcaatgtgaataataaattcacatttctacaaagaagatacaatctacagaatctctgggacacacctagggaagtgttacaagggaaacaggactttaggaaactattataatagtccaaggaagtgttacaagggaaacaggactttaggagactattataatagtccaggacagttattggtggtgacggagattaagagaggcagatggatttgagagatatttagggatagaaatgtacataattaccctcatcctactgtttattccagctaaaagtcacaagacctggcgcttatttgaatatgaggaattgatagggaggttgcaataatgaccttcaggctggatgaataattaaatcatttactgagatgagaaattcagcatgaagaaaaggtttggggggaaagatgtgggagtttagttctagatatgctaaggttgaggtgcccttggagatatataagtaaataagtagatgatattaagtagatatacaagtaaagatattagatggattaatagatgggcctggagttaagagaagtggtctagcctggagataagtatgtcggagtcttcagcatgttgattgtaacagaagccgtactatagatgagataatttatagagagaaaaaagtaaaaagaataaagaggactgtttacgagccttgaggaactctcaacttttagagtcatgcagaaaaatgtcagccatcacaatagagaaggagcaccataataagatgaaaatctaccttagacgacaaagggaagaaagggtctccagatggaggtgtcgccaacctgtgcttctgagaggttaagaaaaagtgaggatcgagaaatgccctttttgattttgtgacatcaaggtcattagtaactttagaaagcacatttccacagagtaatggggaatagacacctgactaaagtgggctgagaagtgaaaacaaagaaggaaaatgaacatattgagagcacgggaataaagagagaacactagctgagtcgtcaggtgggatcaaggaagttttcatttattgtttagttgtttttgctgttagttgttcttgtggtttgctactgcttttcaaacgataaagacccgagcagatttaattgttgatgtgcacaatgcagtaaaaaaggacaattcactttgggaggccgaggtgggcgggttacgaggtcaggagattgagaccatcctggctaacacggagaaaccccatctctactaaaaatacaaaaaattagccgggcgtggtggcgggcgcctgtagtcccagctactcgggaggctgaggcaggaggatggggtgaacctgggaggcggagcttgtagtgagccgagatcgtgcccctgcactccagcctaggtgacagagggacactctgtctcaaaaaaaaaaaaaaaaaaaaaaaggacaattaaaattatagaggagagaaagactgaatgcaggggtcaaattcctgaggaggaaaagacctggcgcatagaagatggagccaaccttgggcaggaggaggaaaaccccctgtatcttaacaggagcagggagcaagaggaaggttacagggcagttgcatttaatcacctaatgaaggaagttaacaaagttccatctggtaaattctattttctttatgaattaaaatatgagaccatctgctgagagtgagagacaagggaggaaaagtatctcaggattgaggaaagcaatacagaacaagagtggaatgtgaagcagtgtggtaagtccactctactttcatgagcatgaacttatgaattaatgaatgtttaccttgttattatacatacactgacattataggagaaattctgttgcataggatagcatacacgacatcataaagagcctatattcccacatcatcaaatcatcaacctagcaggagttcattgtatttttagaaatcttactagtctacaattcatgttattcacacacagtggaaacaaaattgatttcaggggagaaaaagtgtgtgtgtgtgtgtgtgtgtgtgtgtgtgtgtgtgtagtttataatattgttttccaactacaacacatttccactaagttgaacaaattgagatgattatattttttaattggtaaactgtccatatggatgaaggaggcaggtaattcccttcaggtactgctttccttgatttctctctttgcccatccatgaactagcactggtttacaaatttatcatgtagatatctgctttaataaatggctaagacagcactgagcacagagcaaatgccaagtaaataattactgtttgataaaagtgcttcttatcagcaaggccagtatttgtgtgtaaaataatgcttccatggggctcaaaaatagtttgctctcttaaatgagttaaatatacccacagaaatcatgttgacactacccacttgctcagcagagataaacatttgttctagtccagtctgaattcatttaatttcaaaattttggcaatagaattaaggaagtttcaccattcaaaaaatatttaggtataaacaagttacagaatcaccctcacactcctacctatttcagatgttgcagaaggtatagtagagtgtggattattcaccagatggcattttcatttcaggttgaccacagtccagtaagcacattagcaaattgaacagaggtaactaagacccacactatcttggcatgcagctgctgaatgtgtcctttttttatcagagatcatctattctctttcaacatgattggaagcagtctttgctggtggttttgtaaattgctcattaatcaaaatggatttatcgggcatccatagtatacaaagcctgtactaagtgattcaaaataacggttgcctagttaccttaaaatggaaaaattcccctaggaaggttaaaatcaaaggaaaaggagacaagaaaacattatatttgatgacacctggctatttcataagggattttactgccattacagccattttcttttaaacataatatccatccattcattcgttcattcaattattcattcatttatgcaagtgagtcaccactataattaaacaaggtctttagcttgatgctataaaggaaacaaacaggattcaatagtggtcgcataaacatgagtcttagcaaattcaccaagcaagtgctagactactgttggtctttatttaataagtccagtactagaacaatcttattctttacttcatgtgaaatctgtagtcatgaggcattagtaaaatgctccttggaaagagtatccttcattttctggttgaattgtaaaatcttgctgaatacagatctactaataagttgcttttatttaaattaaactagtacatctgataattttttttttcctgtggtcaggattagatttattttgtactagcccttctagtttttaatacaagagaccacagaaaggaaagttaactttgattttctgagcaaatgcatacttataccatgaatacacaatgttgccagtcacaaccaaccctcagctgctcagcccctgagaaatgaaagccaggcaggttgtgtgctgtactgtggcccaagcatcctcaattgcctctccctattatgtattgaatttgtgtgctcagttttaatccctatatttgttacctaggggtgcttcaacaaactacagccatccctcagtgtccaaggggaattggttcccagactccctgttgaggaggattgggtatttgaggatacccaaatctacggatgcttaagtctcttctataaaatggtgtagtgtttacatataacctattcacatcctcctggatactttagatcatctttagattacttgtaatacctactgctacataaatagttgttatacagtattttctttagacaatgatgacaagaaaacaagtctgtacatgttcagcacagacccacccatccatttttgcttctgacatatttttaatttgtagttggttgaatccatggatgtggaactcacagatacagagggccaactatactagtaactgggtggcttaaacaatagaaatgtattgtgtcacagctttcaaggatagaagtccaaactcaaggtggcagggatggttccttctgtgggctgtgagggaaggatctgtcccaggcctccttggtttgcgaatggctgccttttcctgttatatcttcacattgtcttccctctatgggtgcctgtctctgggtctaaatttcccttaaataaggatactggtcatattggattagggtccacttaatggctttattttaacttgattatctttacaatgattctatatccaaattccccaaataagatcatattctaaagtactataggttaggattccaacctttcttttcgggggcataatatgggggggacacaattcaatctataacagtccctcttaagacttgatcacccctcagtctttctctttctctctctctctctctccacccccacctccaccaccctgtctctccaggaaatcttcatgcagttcttgtatagagtagtaatgcccattttgtctgtaagcctaagccatgttacctaacacagttaacctaaagcattgaatgcattccctgaagtacaattctcaaatttccttgaccccttattgtccaagtgtcagcattctcaagatgagaaggatgagctttactcctacatgcttctcagctttgtttccccttgcctttctctgctgcaattgtctttgttctggccactgtcatttcttgctgagtgtatgcactgatttgctaatgaatcttcccgctttcaacttcatctttctccaatctatactctatactccacattgcttctagagggatcattctaaaacagaaacctgatcatgccatgttcacttctgctgtcagatgaaatccaaacttctgcctgttactccttgttctttatgcattctaccctagtatcattctatgctctaaccatgccaagtgggcatagtctctgaatgtactctgttctttcaccctctctgcatctctgcacacactgccccttgcctggagtgccataccttattcatctatctaactcctccttctttgaggctagcaaatcatgtagcacttcctcccacaagccttccttcattcacattcctccccttctactctcccagagcaccctatgcttatcttgttcattgcccttattatccttaattttaacacattctaagctcctaaaggtcaacacttataccttttgctctgttccttatgcaatatttagcacaatgcctagaacatcagaggtactcaataagtgcttattgaatggatcagaactatagggtatttacccaccaagatcaatttgagggtctctaaaagactcgtgtgcatcaagaaatgtctccacgtttgcaaattctacctttactcactaaagaatttagtaacaaagggaatacatcagtaactccaagagaggtcagtaacttccctgagttctccagatcagttagttggccctaagggggaaatgcatagctaggtatgagtcacaagggactagtcatagcagttgagagacttggaagtaataggattgatgcaaaacctaaactatgggttaatggaatcaacagaggaaaaaatgcaaactatttccttacctaaccagaaaagaagtaacagttatgttgatgctctcctctacctgctatggcgcttattgggggcaattctgtggggctgagtggataaggtctcatataaaattacatagaaactgttttgatctatattcatcccaattctaatcattttttaaaaaccacaaaatttccctttaaattctggactcctttaccttagaattcatgatcacagcccaaagactatcaattattatgaattaagcctgggtcaactgagcaaactggcttcttctatactaaacccaagtgatcaaacacaattggggaaaattatgtagccatgcaaactaagtctttacccaattttaacaacaacaacaacaaactcaggcattgtaggagtttatattttctgaaagtggctgcaagaatatcttcttataatgtgactttagttaacactccttcatcaaggggaggcaagaattaaattccctccacttaaatgtaggcaggcttttgactacaatggaagtgatgttgccttctgatgtctcattttcttagaatgtttgcttagaatcccaacacagaccacgagaaagtccaagtaggccatggcagcgatatgagtatggatcttgagaataaaacctccagaccccagttaagcttcccccgttgacaccacatggaacagagacaagctatccctgccaagccctccccaaattgcagatttaaaagcaaaacaaatgactgttgttttcactcactaagctttggagtggtttgttatgcagtgacaataaccagaagagattttgatagttggatatggggtgctgccaaaacaaaaacttaaaatacgtggcattagcaccgagattgggcagcagacagaagctggaagagccccaaagccagtgcctgtcaagccaaaagggccaaggaaggatggatttgtggaagccttaaaagctataagaaaggtgttgatgaaagcttaaaggaaagaaaacgtaactgtaagctgaaagaaagtttcttctctctctgcagtgttttacctagacctgtggcaaaaatctaagactcactccctctctctgtgcatgtacaaagaagaggtttggtaagcagggtgatgacagccttcaacaagccaggaagagagctctcaccagaacctgaccatgccagtaccctgcagatttccagcctccagaacaaggacgtaatacaaatgatgcagcttcctcttagttctttggggatgcttgctctcagaatccaggcagtagtcaggaggaaacccaagcagtgcctggagagcaaaaaaggcctccagtccattgccttagccaagttactggtacatagccaacactaactttcagccatatgagctggccatcttaaaagtgttcctctattccccagttgaacagcccgagatcataagatgtgacacagataatcagtccctgacaagccctgtcaaacttgcagatttgtgagcaaaataaatgactgatgtcagtttgttttggggtggcctgttaataacaatagataactgatacaggcatcatctcctttatgtcttcctcaagctccaggtaaggttaagtactcccccatttttgctcccaaagaactctttgtgaaacactatcttagcaattattgtgctctgttgaatttaactcttcacttgtctacctcttcgagctcaagggtaatatcatgctttttgaaaaattacctcctcaaatatattatatttgtcacattctctctttcttctcctctggaactttgattagacgagaaaactttgcagtatatctttcaagtctctcagcttctctttcatattttccacatttttgtctctgtgcaacattctgaaaaatttcttgtggcttaatttccagttcactatatctcccttcagctgaatctcatctgctgttccactcattcattgagttttaaattgcatgtgtgtatgtgtaagtaattggaatttttttcatttctaaaagttttttttttcctctccaatatgctaggtcattttcttttagtttctattcccaaaaaatatcttcaggctcactttttctttataatggcacagtcattgtatagtctacatctactaattccagtatttgaaagcacttaaggtgtggatcggctcttccttgtttttgttggttcctgttgggttttctttccctataggcttaattattagaaactgttaattttaataataggaaaattattcatagaaattatttggggccctggaggagagtatatttctctccagagggattacatttgcttccacttgatacctgagggtattagtttaaatgcatgaactgacattttttggaccaccaaggtgatatgaattttgtgtggcaatctgtgagggctagttagtagtaataattcttcaggaatttcccaccccctgacctgccttgttctgctcacaaaaaatcatctttccttggagtccccttggggtggggaatacaggattacctctgattcctctaaggctgtagcccttggaatcctagttctatggaggaaggatttcctattacagtccctgagctggacaggctgtgtagatatttgttttcagtatccaaagccacagaagtcttgagcactgaagttcattagcaggttcagtaagctcccccaggacaaatgtgactttagtgcagcatttatttcctaccctcgccaatgttttggcttgattatttcttactaaccaactaataaaaagaaattcctaatttagatgtgattcgatttctgtaattttcatatcagctttttgatacttttaagaagtttttttcttttctatatcgtatccagcatttttatttgttttcagcaagagttgacctgagcctgatcagccttgttatctgtgtccatgtcattttcatccttgtatcctcagcattcaaaattgtgccccagcatgcataagaactcaattagtttttgactacttaatcaatacatagctgtgtcttcaattttgcattccttcctctatcacacctgatattcccctaccctctgtgccccaattaaagctctttcacattttgcatatctatttcctgcattttcctattttaatgaagcttccccccctgaatatgctatttccctcattatctctcttacggaaaaggaaaagttctcattcttgtcaacttccatagcctggggtcagcattgttttcattctccatgaccgctgtgggtcactttctattatttggccttcatccaaactctgatgctcatctgaagtttacactattctattataacattctttttgtaattttattgttatcatatgtggacctccagtcatatctctacatttcttgagggtttcagtatttgattcctaatatctaccccacctcatcccctagtaaaatgcagcactacagcatagtgtttaagagcacaagttagacaactcaaggtcaagtaccaaatctacccctcattaacatgtaaccttgggaggccagctaatgtttcaatgcctcagtttccttatctctaaaatgagaataatgatattaatacctcacagcattgtaagaatcatatggaataatgcatataaagcacttagaacagtatctgccacataataaatgctcaataaatttactattttcattactgcactattaccttaaaagtcttccttctgtatgtttatgattcattaacaccctagcctcagtactgctcaaaaatccatttttttcacttgtacaaaattccctagactattacgtataatggcttttctgaattttatttacttatttatttagagacagggtatcactgtgtcacccaggctgcagtgcagtggtgtgaccacggtttactgtagccttgacctcccaaactcaggcaatcctcccacctcagcctcctgaatagctgggactacaggcatgggccatcacgtccagctaattttttaattgtttgtagcaatggggtttcaccaggttgcccaggctagttttgaactcctgagctcaagtgatccacccaccttgtctaggattacaggcatgaggtagtgtctgtaataggctagtgctaagaatataggcatgagccatcgctcctggactgaattttaatttaacccttcttaagatctagctcttactttcggccaataaccttttatcttacccagaaattgaatccatttgaaaataaatatttcagaatttctctatattcataaccatgctgtcttctcgctactctgtggggaagcaaggtctgtgtttccctaaactagctgagtcttaacttctacccattctgttctttttattctttatcttcaataccttgctctaccagaaaattcctctaaacttgatcaagtcttatttatcctaacataaaccagctatttccctcttgcacctgctttcttcttatgttactatcatacctcttcttctaatctccttgaaagagtcatccgtactctctactccatttcccagtgtcttatttcccatttcccaatgtctcactattaacttccagacatctacttgtaccacatcacttctaaaatttactattcaaaagtaagttgcgactgcattaccaaaccaaaaaaaaaagcctctcttcagaatttttcttacaactccttcacagcattaaatatattgaccatccacttgaaaatttcctccttcattagctttcatataatcactctgtattctttcttaaagtaatagaaagaaactataatggtagtcaaaaatccatgttcaagcataggccccactattgctcttaaaactctaatttctttatcagcaaaatagggataatatttgtcttgctttgttcactagtttgtaatgcaaaaaataaaacaaaataatgaatctgataatgccataaaagacatgaaatatataaagcagctaagtaagatttgataacttggtaacagataggctacagaaaatgatacaaaaattgctaccaattggctgtgaactcctgaaggaaccaaagctgtgtatcttacctagaaggttttttcagtattaaaaggtttcaaagcatcttcatcaaagcattaccatgtccattatggcttttaccaggaagttaggagacttcaaataaaaaaccttctgacctacctggactcacttcaaaatgaaaaaataattattggaactacattgggggaactttcattttgataacatagtaggaaaccaaaatgttaatgatgcatcttcatatgaataagcaagtaaattgaatcaggccaattgtgagtaagagatattaccagttcttggggaaggtgcccttgcaatttctaaggagcaaggtttctttgtaacagctgtgtccatgagatcacacagaaagttctcattttctgaaggaaatgtatccagagaagcagatggtacaatttccatagtgtaatttctcttctttggataggactcctgaaaagaagaaaaaataaaaacagctttgtgatgaagaaacagccttgtttaatttataaaaactagaaaagataatcaggttcattagttctttccaaagtgattgacagctgatgattcatctgtttgaataaattatagaatcatgtaaacccaatatcagtgatatttttaagagtcctcataatttaaaaggactgaatttattactgaattagtaaaggtattgcccttttttgtaatatatatctattatctagttgtggcataaactgctggttaactaatcaacagtcatccccaagactctactcctttgccggcctcctggagacacccatataactcggagacacccatataactcaactttggcccattagatgtaagatgaagtttgctaaaaggctggtgggaaaaaatttttccccaaggaagaagcatataaggaggctctttcagagccaaggccatccccaggctcctctctttggatgcagttttgatatctggagctagggcaagcattttgtgaccaaaaggcaagaatcttcagatcaaaaaggtaacaagccaagaatggcaacagaaggataaaaagagcctgggacattgatcatatcattgagctgctcaaatagacccagggccagtttctccagtcttcttacataaataataacattcttacagtttgagccattgctaattgggttttctgtcatttagagttaaatgtcttgccatccagcacactagtatctttccttgtaaataccattaactaatatactaaggtactcttttcaggttaggataaaatataggtccagttctatatgattgattctttgatatattctaaaaattagaatttatttcattttataagattttgatttcctgtacataaggcattaattggtcaacaaatacttattgggcatctactatatatatgtagaatatatatagcatatttatatattatatatatatgtatatatatataatgtgctaaatgctggactgtttttaaactaatgagacataatccttgctctgaagaagttcacagtctgctggagaagactgtgaaattctgcatgatgaaattcacaattaatcatattttatttttgctacagatcctcctcagctttacaaaaaaacccaaagtaagttgaaaatattgtaagtagaaactgcatttaatacacttaacctaccaaacagcatagcttagcctagcctaccttaaatgtgctcagaacacttacattagcgtatagttgggcaaaatcatctggtaacacagtacattgtagaatattagttacttacccttgtggttttgtggctgactgggagttgtggcttgctaccactgctcagcatcatgagagagttatctatcatagggtatattgctagcccaggaaaatattcaaaatctgatgtacggtttctactgaacatacactgctttcacaccattgcaaagtcaaaaactcgtaagttgaaccatcatgagttgcagaccatctgtatgtgctacttttataaagtatgcctcacaatcaagaaaaagacaaataagaaaatagactaatatttttgaaaaatctccctaagtatattctagggctgataaagatttagtacgaattcctagtttttctacagtacagcagaattcaaggtcagggtaattgctttcagacaataccagaccctcacacatcagagagtcaattatggtcatgatactccattgaaagcaggaaattgggagtaatttatttttaacaacaaagggtgacaaagtagaaggcatccagaggaaagtaatcaggatggcatataattctgaaaccatgtcagagaagaaatgatgaaaggaactgcagtgttctatccagagaagccttatagccacataatagttttctcaatgatttgaaaggctatccctcatcaactatcccacaaaggggggatggagaaaagttgatgtggtagatttattctaaggcccataaagacaagacaaagactaatgtttataagtcaagaagggcaaatttggctcaatacaaaaaataattttctatgaattaatgatattgtttaccttttaaaataaaaaggcactataaaatgagttaacaaatagcattataaagcaacagaaggaagtcctcattactgaaaatcttccagcagaattatctgctgataaaattgtggatgaaacacattgtacaatgagtccaacaggttactataagctccatgaaggctggaatttgtcttgtccactactctgtccctagaatctaatacaggtcctgccaatagttgatgagttgatgctcaataaatatgtattgatcaactgaacagtctctagtgtcctttaaacaaagctaactacaagttatggaaatgattttttttcaaatgtaaattattttgcctttcagttcagttaatattgttcaccagtttgcatataaaaagtgaaaaactgagattacaacgataagattgtaaagattctatggaaaaaaagagtctccagttaaactcctagttccatcctgaaattaaattaatcaaaacaacccatggatttagttaagttggaattttacagtgtgtatgaacacttctgaggatttttaaagcctcgaaaaccactttgaaatttaatcacaaagcatgggttaatttgctttcttccttaaaaatgaagtatataggtttattagagaataatttgaaaacataaagaaagaggaaaataatcacatgaaaatcaagcatgctgagataactgagggtaatattttggtgaccatcctcccagactgtttcactctgtgaatgtgtgtggacatgtgagtatgtgcaaaggaaagaaaaaatattttaaacaataatgaagtactccctcttctgcttcctaatggagggccataatttcttcttagaatgtaagtctttgtagaacctggcttccttagggaaggtgaggcccccgcgggaaggagttggtaaaaacgaagatagtgaaacaatgcttttgtaaccaaatatttcaatgtcaagaaagagagatagttgaacaaaatatctgacaagtgaccgtcaaaagaggatatgcaagataatttttttaaaaaaatggatccatgtgtccactactcagtttaagaggtagaatattaccattgtatcattgaaacctgtcccccaacccaccccatgttcatctttccaattttaccctttttcctcctctaccagggctaaatgctttctgagctttgtgtttttaattgcttggactgtgttaaattttaactatacatgtaagtatcaataaaaaataaatttttagtactgtatgctttcaaactttatatatatagtatcaaatgctctagttcttctgtgatttttctcaatcaagattatgtttctgaatttcatctattttcagtgtggtacaggagctcattgtttaagattaccacaattcatttacacattctcctgacaatggacttttaaatgtttcctaggtgttttgttatttaggataatgttattataaattttcccatatgaagtctcttggagcaagtaaccagggttatgctgcctattctagtagtgatggggaagagtcaagaacagacagcagacgagaaaaataaatgaaatcaagagatgataatgagaatggaaattgtatgccctgtagattctatagaatcttaaggatagcatttgcagttttctacccaaagtggcaggagggttcaaaggatattctgtaaatcttattaaaatattatatataagtatagtattatataaaatatttcctaatctgttatttacctctaatgatatattttatacccttttcaatgacaattatatgtctacatgatgaacttgggtcccaatatatacctggtcataatttatttggccaatcctatcatattgaaattttaatgttttgctttgaaggaaacatttttgttcatatattttgtttacatattcaactattttgaaatagaattcctgtgataatacatatatgacttatgtttacatataattgaatctgtatctggactttctaattggttccatatatatgtctattctagtacaggcatacctcaaggtgtatcgtgttttacagatattgcatttttaaaaaaataaagatttatggcaaccgggcattgagcaagtctatcagcaccatttttccaacatgttcttattttgtgtcacattttggtaattctcctaatatgtcaaatttttcattattattatatctgttatggccatctgtgatcagtgagctttgatgttactgttgtaattgttttggaatgccacaagccacaatcatataaaacagtgaacttaatgcataagtgtagtatgtgttctgactgctccaccgaccagccattcccctgtctcatcttctccttgggcctccctatttcctgagacacaacaatattgaaattaggccaattagtaacccttcaatggcctctaagagttcaaattcaagaagagtcacatgtctctcactttaaataaaaagctaacaatgattaaggttagtgaagaagacatgtcaaaaagctaggcctcttgtgccaaacagctaccaagctgtgaatgcaaaggaaaagttcttgaaggaaattaaaagtgctactccagtgaacacacaaatgataagaaagggaaacagtcttattgctgatatggagaaagtttcagtggtctggatagaagatcacaccagccacaacattcacacaagccaaatcctaatccagagcaagactctaattctctttaattcaatgaaggctgccagaggtgaagaagctgcagaagtttgaagctggctgtggttagttcataaggcttaaggaaagaaactatctccataacataaaagtgcaaggtgaagcatcaaatgctaatggagaagctgcaacaagttatccagaagatcccgctaagacaattgatgaaggtgactacactaaacaatagatttgcaatgtagatgaaacagcctcataccagaagatgtcatttaggactttcacagctagagaagagaagtcaatgcttggcttcaaactttaaaaggacagtccaactcttttgttaggggctagtgcagttgatgactttaagttgaagccaatgctcatttaccactccaaaaatcctagattccttaaaaatgatgctaaatcaacttttcctatgctctataaatgaaacaacaaatctggatgacagcatgtctgttggcagcatgtctgtttacagcataatttactgaatattttaagcccactattgagacctactattcacaagaaaagattcctttcaaaatattactattcattgacaaagccacagatcacccaagagctctgatagagctgtacgaagagattaacgttgttttcatgactgttaacacagcatgtattctccagcccatagatcaaggattaatttagagtctcaagtcttattatttaagaaatacattatataaggctatagctgtcatagaaagtgattcctctgatgaaactgagcaaagtaaattgaaaacctagacaagattttccattctagatgccattcagaacatttgtgattcatcagatgaagtcaacatcaatgagtctagatgaagttgactccaaccctcagggaggactttgataggtttgactttggtggaggaagtaactgcagatgtgacggataaatagcaagagaactggaagtggagcctgaatataggactgaattgctgtaatcccatgataaaacttgaatggatgaggagttgcttcttacaggcgaacaaagtggtttaagatgaaatacactcctggtgaagatgctgtgaacattgtagaaatgataacaaaggatttagaatattacataaacttcattgataaagcagtggcagggtttgagaggattgactccaattttgaaagaagttctagtgtgagtaaaatgctatcaaacagctttgcatgctacaaagaaatctttcatgaaaggaagactcaaataattcagcaaaactacattgttcccttattttaagaaactgcccactgattttgtatcctgagagtttgctgaaattgcttatcagcttaagaagcttttgggctgagatgatggggctttctagatacaggatcatgtgatctgcaaacaaatattgtttgacttcttctcttcctatttgaataccccttatttctttctcttgcctgattgccctggccaggacttccaatactatgttgaataggagtggtggagacagcatccttgtcatgtgctggttttcaaggggaatgcttccagcttttgcccattcagtatgatgttggctgtgggtttgtcatatatggctgttattatttgaggtatgttccttcaaaacctagtttattcagaatttttaccatgaagggatgttgaattttatcaatggccttttctgcaggcaaatcatgaatgaactgccacatcatgaatgaactgccattcacaactgctactaagagagcaaaatggctaggaatacagctaataagtgaggcaaaggacctctttaaggagaactacaaaccactgttcaaggaaatcagagatgacacaaacaaatggaaaaacattccatgctcacagataggaagaatcaatatcgtgaaaatggccatactgtccaaagtaatttatagacaatgctattcccattaaactaccattgacattcttcacagaattagaaaaaaactaatttaaaattcatatggaaccaaaaggagcccgaatagccaagacaatcccaagcaaaatgaaaaaagttggaggcatcacgctacctgacttcaaactatactcaaggctatagtaatgaaaaaagcatggaactggtgacaaaaacagacacatagaccaatggaacagaatagagaactcagaaataatatcacacatctacaacaatctgatcttcgacaaacctgacaaaaacaagcaatggagagaggattctctattttaaaaatggtgctgggagaactgactagccatatgcaggaaattgaaactggaccccttccctacaccttatacaaaaattaactaaagatggattcatgatttcaatataaaatgtaaaactataaaaaccctagaagaaaatctaggcaataccattcaggacataggcatgggcaaagacttcatgctgaaaatgccagaagtgattgcaacaaaaacaaaaattgacaaatgggatctaattaaattaaaaagcttctacacagcaaaagaaactatcaacagagtgaacagacaacctacagagtgggataaaatttttgcaatctatccatctgacaaaagtctaatatccagaatctataaggaagttaaatatataagaaaaaagcaattccattaagaagcgggcaaaggacataaacagacgcttctcaaaaaaagacattcattgtccaacgaacatgaaaaaaagctcaacaacactgatcattagagaatttcaaatcaaaaccacaatgagatcacctcatgcagtcagaatgatgattattaaaaagtcaagaaacaacagatgctggcttgttgcagaaaaaaaaaggaatgctttcatactgttggtgggagtgtaaattagttcaaccattgtggaagatggtgtggtgattcctcaaagatctagaaggagaaaaagcatttgacccagcaatcccattattgggtatatacccaaagtattataaatcattctattataaagatacatgcacatataagttcattacagcactgttcacaatagcaaagacatggggtcaacccaaatggccaccaatgatagactggataaagaaaatgtggtacatatacaccatggaatactatgcagccataaaagggaatgagatcatgtcctttgcagggacatggatggagctggaagccattttcctcagcaaactaatgcaggaacagacaaccaaataccacatgttctcacttataagtgggagctgaacaatgagaacacatggacacatggggggaaaaacacacactggggcctgtcagggaggcagggagaggagaccgtcagaaagaatagctaatagatgctaggcttaatacctaggtgataggctgatctgtgcagcaaaccaccatggcacacgtttacctaacaaacttgcacatcctgcacatgtaccctggaacttaaaagttgaaagaaaaaaaaaaaactgtcacagtcacctaagctccagcaaccattactctgatcagtcagtggccattcaaatcaaggcaagaccctccaccagcaaaaaattatgactcactgaaggctcatatgatcgttggcatgttttagtaataaagtatttttaattaggtatgtactcttttttagacataatgctattgcacacttcataaactacagtatagtgtaaacattactttaatatgcattgggaaaccaaaaaaatcatgtgactggctttgctgtaatagtcactgtattgtggtggttgaaaccaaactcacaacatttgtgaagtatgtctgtaccagaattacactgtcttgattagtggagcgtttaaattgattttactatctggtaggataaatctttcatcatgttaatctttcccaaggcattaattattaacttcatgtttatttttcaaaaagaaaaaatttgaaacattttgttaagttttcctcaaatcattccttctcatttgttccctatcagtaatcaatacttccatatatccaggcactaaaagaacctgggatatggttcacttttcattctttctctgtcattcccaataaatcctcaagtcctatactttgccattgaattatacctcaaacacatttatttctctccaccccagctaccgcatgctagtccagaccaccattatatttcacctgaactgctggaacaacttccaaagtatcttctttgtctccagtcctgcctctcttctaatcaattcattttcaaaactagcttgaagcttctaagagtaagtaaggtcaaagcaaactcatttattttcatcataactttatttgatgagagaatcataaaatgctagtcatagaacacgttgattctttttaaacatttaacacggtctctcataatatctcagaatttccttgctgaatgatttcattaaatacattaatgatctaaatagtaaattcatttaattaacaagataggaaagaagaaacaaagttccttgagtaataagtttaaacgtaatcccattagttgataagataaatgggattaatttctaaagacatacttatctagcacctagcaaaattccatgttcatagtaggactctatgaatatatgatgaaaaaataaatgcataaattaccatatcagttagaatttcatggcttgcaacctctgctagaattaaagcaccataggggcaagaaccatgataatcttcatatagtacgtatttaataaacatttgtcaaagtctgaaacaatgtcatccaaaaacaatcacagattcaaactatcacaaatccaaaactaccacaaattccccactgtgggaagaattacaacttatatttatgcagtgttttatcatctgcaaagtgaatactattttatttgcccagatgattctcatttagccctcacaacaatccagccaatgctactatcaccgccatccagaaactaggactgaaattattaagtgacttgtccaatattaagcatcttgttaatggaaatgttagggatccaaccttggtcttctggcaccagatctagtgttcatgtgattgtgtcaaagataaaaatgactatgaccagatatttattgccagaactaagggaaagaggacactctgcacatcgttaggtagtatctagctctgccaattttcaagcctttgtatgtccccttccctgcactgggaaacgttgacctcaatacacagattaactgccaacatatccttgatggttaatcctggtaataggcaagagggattaaaaggactgcaatgcaacaatttctgactccttcaagactcaattttctccagtctagcaatattgggctcaaaatagattagtagtttttgcttttttcttgacatttggcctctatcatttaaaaaaaaaaaaacttttaaatatgcaacttttgtgggtgtatagcaggtatatgtatttatgtggtacatttgatattttgataaaggcaagcaatatgtaataattacatcatggaaaatggggtatccatcccttcaagcatttatccttgtgttacgtaagtccaattatacccttttagttatcttaaaatatacaattaaattgttattgactatagcgcccctgttgtgatatcaaatactccattttatttattctttctaactatgttttgaaccaataaccatccacaactcccaccctcagacccccactattcttcccagcctctggaaaccatcatcctactttatgtctccatgagtacaattattttgacatttagattccacaaataagtgagaacatgtgatatttgtctttccatgcctggtttatttcacttaacgtaatgacctccagttctatccatgttgttgcaaataaaaggatctctcttttacggttgaataggtactctgctgtgtataagtaccacagtttctgtatccattcttctcttgatggacacttagattgcttccaaatttttctattgtaaacagtgctgcaacaaatatgggagtagagccatctcttccatatagtgttttcctttgggggtggggggtgtatataaccagcaatgggattgctgaattacatgatagctccctttttagttttttgaggaacctccaaactgttctcctcacattcccaccaacagtgtaccatggttcccttttctccacatcctcaccagcatttgttattgcctgtcttttggataaaagtcatttaactggggtgaaatgatatctcattgtagttttgatttgcatgtctctgacgatcagtgatgctgagcaccttttcatatgcctgtttgccatttgtatgtcttcttttaagaaatgtctattcaaatctgttgcccattttctaagtgggttattcgattttttcctatagagttgtttggactgcttttatattctagttatcacctgtcagattattagtttgcattttctcccattttgtgggttgcttcttcactgtgttgtttcccttgctgtgcagaagcttttgaacttgatgtgctcccatttgtccatttttgttgtgtttgcctgtgcttgaggggtattactcaaaaactttttgcccagaccaaatgccctggagagtttccccaaacttttcttatggcagtttcatagtttgacatcttggatttaagtctttaatctattttcatttgatatttgtatatggggagagataaggttctagtttcattattccgcatataggtatcaagttttgccagcacagaatactatgcacccataaaaaggaacaagatcatgtcctttgccgggacatagatgaagctggaagccattatcctcagcaaactaacacaggaagagaaaaccaaacacctcatgttgtcactcataagtgggagctaaaaaatgagaacacatggacccagggaggggaacaacacacccaggaccctgtcagggaggcagggggagggaaagcaacaggataaatagctaatgcatgtggggcttaacacctaggtgatgggtggataggtgcagcaaaccaccatggcacatatttacctatgtaacaaacctgcatgttctccatgtgtatcctggaatttaaaataaaattaatttaaaaaaaaaagactgtttttttcccaatgtatgttcttggcacctttgtaaaaaatgagttcactgtagatgtgtggatttgtttctgtgttctctattctattccattggtcaatatgcctgttcttatgcagtactatgctgttttggttaccatagctctgtagtataatttgaatccaggtaacgtgattcctccagtgtggttcttttcttctcaggatagctttgtttcttctgggtcttttgtagttccatataaattttagaattgcattttctatttctgtgaaaaatatcattggtatttgagtagggattgcattaaatctgtacattgctttgggtagtatggatatttcaacaatactgattttaccaatctatatatatgaaatatcttttcattttcttgtatgatctttaatttcattcatcagtattttatagttttcattgtagagatctttcacttctttaggtaattcctagttatttaattttagttgtggctattgtaagtgcaataactcttttgatttctttttcaggttgttcactgttggcatatagaaatgctactgatttttgtatgttgattttgtatcctgacactactaaatttatcaattctcattctttttggtggagtctttaggtttttccaaatataagatcatgctaggtgtggtggctcacacctgtaatcccaacactttgggaggccaagatgggcggatcatctgaggtaaggagttcgagactagcctgaccaatgtggtgaaaccctgtctctagtaaaaatacaaaaaaaaaaaaaaaattagctgggtgtggtggtgggcgcctgtaatctcagctactcaagaggctgaggcaggagaatcgcttgaatatatatagccaacaagaatactttgacttctacctttccaatttggatgccctttatatctttctcttgttggattgctctatctaggacttccagtactatgctgactaacggtggcaaaagtgataatccttgttgtgttccagatcttggaggaaaggctttcagtttttccccagtcagtatgatactagctgtgggtctgtcatatatagctcttattatgttaagatatgttccttctatactcagttttttgaaggttttctgtgatgaaaggatgttgaatttcatcaaatgctttttcagcatcaattgaaatgatcatatggtttttatcctttattctgttgatatgatgtattatattggttgatttgcatatgttgaaccatccttgcctcctagggataaatcccacttggtcatgataaaacatctttttaatatattgttgaattcagtttgctaacattttgttgaggatttttgcattaatattagtcagagatactgaccagtatttttttttatgggtctttgtctggttttggtatcagggtaatgctggtcttgtagaatgagtttggaagtattctctcctcctctactttttggaatagtttcagtaggattagtattagttctttaaatgtttggtagaattcagcagtgaagccatcaggtcctaggcttttatttgctgggagactttttattacaccttcaatctcattacttgttattagtctgttcaggttttgaatttctttatggctcaattttgataggttgtctgtgtctagtaatttatccatttcttctgggttttccaatttatcggcctatagttactcatagaacccattaatgatcctctgaatttctgctttataggttgtaatgtctcctttttcatctctgaatttatttggatcttctctctttttttcttagtctagataaaggtctgtcaatctgagtctggctaaaggtttgccaatgtttatcttttcaaaaaaacaactttttgttttactgatatcttgtatggatttcttcatctcaatttcatttatctctgctttgatttttaatatttcttttctactaattttaaatttggtttgctctagcttttctaattctttaagatgcaccaattggttgtttatttgaagtgtttcttccttttgatgtagacacttataggataaactttcctcttagtactgctttcactatatcctatacattttggtatgttgtgtttccattatggtttgttttgagaaatttttcaatttccttcttaatttcttcattgacccctggtcatttcagggcatattgtttaattttcatgtgtctgtatagtttccaaaattcctcttgttattgattatatttattccattttggccagagaaaatgcttaatattatctaaatttggttgaatgttttcaaatttgttttgtgagctaacatatggcctatccttgagaatgatccatgtgctaaggaacagaatgtgtattcttcagtcactgagtgagatgttttgtaagtatctattaagtgaatttgatgtatagtatagattaagttcaatgtttctttgtagattttctgtttgaagatctgtccaatcctgaaagtgggatgttgaagacctagctattattgtattaaggcctatctgtctctttagctctaataatgtttccattatatatgtgggtgccccatggttgggtgcacacatatttataagtgttatatcctcttgctgaattgacccttttatcattatataacgaccttctttgtctgacttgtcttatagtttttgtcttgaaatctactttgtctgatataaatatagctattcctattcttttttggtttccagtggcttggaatatctttttccatccttttattttcagtctatttgtatctttatagatgatgtgtgtttcttgcaggcacagatcattggctcttgttttttcacctattcggccactctatttgaagtcagtcttctcattcagactctcattcagtattctcttccctctttccttctgtcttttctcccttttagtgaaagtgattttctctggtgctatgatttaatttcttcctttttattttttgtatatccattgtatgtattttgatttgaggttaccatgagccttgcaaataccatctaataatccattattttaactggtgacaatttaacaatgattgcttaaacaaacatgcaaaaagtaaactaatgaaggctctacactttaactttgtctgcctgctttttaacttcttgttgcttctctttatgtattattgtattgtgtatgtcttcaaacgttgttgtagttgttatttttgattggctcattgtataatctttctacttaagatatgagtagtttacatgccacaattacagtgctataatattctctgtttttttctgtgtgcttattattgccagtaacttttgtacctatagatgatttcttcttgctcattaacatgctcttctttcagatttaagaactccctttaacatttcttgtaggacaggtctgttgttgatgaaatcccttagctttggtttgtctgggaagatctttatttatctttcatgcttaaagcatattttcaccagatatactattcctgggtaaaagtttttttccttcagccgtttaaatatgtcatgccattctctcctggcctgccaggtttctactaaaaagtctgctgccaaacatattggagctgttatttgttatttgtttcttttcttttgctacttttaggatccttcctttatccttgacctttgggactttgattattaaataccttgaagtaatcttctttggtttaaatctgcttgcattctataatcttcttgtacttgaatgttgatatctttctctagatttgggaagttctccagtattatccctttgaataaactttctacccccacctcctctttaaggccaataactcttagatttgaccttttgaggctattttccagagcctgtagttgcgctttattgttttttgttgttttttcttttgcttcctctgactgtgttttttgttttgtttagttttttgttttcttgagatggagtttcgctcttgttgcccaggctgaagtgcaatggcatgatctcagctcactgcaaccttcacttccttggttcaaacgattctcctgcttcagcctttaagtagctgggattacaggtgcccaccaccatgcccagctaattttgtatttttagtagaaatggggtttctccatgttggtcaggctggtctcgaactcccaacctcaggtgatctgcctgcctcagcctcccaaagtgctgggattacagacatgagccactgttcctggtctgactgtgtatttttaaacagcctgtcttgaagctcactttcttctgctgcttgatcaattctaccattaaaagactctgatgcattcttcagtgtgttgattgcgttttttcagctccagaatttctacttgattctttttaattatttcattctctttgttaaatttatgtaatagaattctgaattccttctgtatcttatcttgaatttcttttgagtttcctcaacacagctattttgaattatctgtctgaatggtcatgtacctctgtttctccaggattagtccttagtgccttactgagtttatttggtgaggtcatattttccaggatggtcttgatgcttgtagatgttcatcaatgtctggacactgaagagttaggcctttattgtagtcttcgcagtacaggcttgtttgtgcctgtccttcttggcaaggctttccagatactcaaagggacctaggttctaagccccctaatgctgtggtttttgcagactcatagaagtatcattttggtgatcttggataagatctgaaatgattctcttgattaccaggcagagactcttgttctctttccttactttctcctaaacaaatagagtcagtgtctctctctcaatctctcgctctctctctctctctgctgagccacctggaacttggggtatggtgatgcaagcacccctgtggccacagccattgaaactgtgctctgtcagacttgaagccagcacagcactgggtcttgccccacacacactgtaaacactttctggctaccacctctgttgactcaaggcactagggctcagtgatcagcaggtagcaaagccagccaggtctgtgtccttccctttagggcgggaagttcccctaggtcctgggtgggtccagaaatgctgtttgagaagcagagattggagtcgaaaaccttttaagtttacctgatgttctattctactgcaggtaagctggctctcaaaccacaatacaaagtccttcctagtcttctccttactgtttttctaatgcctgattatggatcctagacttgtttttgtacttgaatttttacaatagtagcaggcctaggactgtgttctctgccttggtctttgacagttctcttccaagagattgatgtccagtccctgaatcccaaacaggtcctttaggccctgtgccacctaaatttacagctccaatgggaatgaatagctttgatgctttgccttacttagattcctttatcctacctgctactgtcaattgtgcaatgtgcagaccaaatagtactgcttcaaagtgactaatcatgcatactgacagcacttaataagtaaagagaacattatgccccccaagaaaaataaatattggcaataagaaatctatataataagcgttcatacgttgtttacactgtgttttctataacatttaaaactatcagtggtgggcagaatataacaagtcaaactttattagtgactcagtaaaaggttctatgcttcagtagagaaaagagttataaaaaattcatcatggagctatgtggattagcaatactatgaaaaaaatattaggagttacagctgacagtatgagtcagactgtaacatgccagttaaagaaattaatgtgacattagctgatttaatacaagtatgatatttcacctagaaagagtgacaggcctccactcttcagtgctaattagtattgggaatgatctggcttcacaatttcataaaaggcgggctaactggattgtgctgaatttcctttagtaaggctgtgcaaggtcttattcatcaaagagactgggggagacttggccttctgacttacgaaagatcttagcaacaatcaggaacccagaggtagacacagtagttgcccaaaagtaccaataatgtagtttttcaaatcagaaattaggtggcctagaggcttttctagactactttgatagggcatctcactgaatttgcttcctagcacagctctattcttagccacatgggaaaactaaagcatcttaattgacactacaggggaatcacacatgatgcacttggcttggtgctggggctgacacttgaggagaggcaaagaccaaatggaccgttttctgtgaacataagtgaggaaaatggtgagtattaaacccctgtcatgtgagaaaagattaaataagaaaaggtgctgaggaacgtgtatgacaaacatttaaaaggtaaaatagtgattagaattgttatctatctctaaggaagtagaaataatgcagatggggagatggtaacagggacagatattgcagctgatgataagatttctaataattagagctttgcagtataaaactggctgcttactaagtagcaaactctctgtccctggagtcttcaaggctagcctgatctatacaaggcatcttcttttttttttttttttttttgagacggagtctcactctgttgcccaggctggagtgcaggggcgcgatcttggctcactgcaagctccgcctcctgggtttacacaattctcctgcctcagcctcccaatagctgggaccacaggcgcccgccaccacgcccggctaattttttgtatttttagtaaagacagggtctcaccctgttagccaggatggtctcaatctcctaaccttgtgatccacctgcctcagcctcccaaagtgctgggactacaggcgtgagccaccacacccagcctatacaaggtatcttctgagtgtagaagatagcagtttgaattagacgagttttaagatgctaagtaaatgagagaatcagaatagaagttttgtattagtactatggtacaagttacctgaatatattcactgcttcctgaattttttctgataatgggggaagtaacactaatacaagagtgtgggtttatggcttttttaaagttagaaatgactcacagttccaaatgactcaaggtaggtgaaagtttttggaagtggtctgactactctgacatcttcccacaatatcaagaaaaagtatcccctgaagatttacaatgacattcaaataagaaaaactacaacatgaatatgaaatcagaagaaaaataacttttttttaaaacgaagatactttaggtgggagcaaagaatgaatgacagaaaggcagccatgggggaaggagcatcacgtaacagtggtaggcagaataatggctctgaaagatgtccatgtctgaatccctggaaactaggaatacattacgtaacacatagcaaaaggaactttgcagatgtaagtcaaggatcttgctatgaggagatcatactgcattatccaggtggcccactatactcagaaaggacattataagtagaagagggagaaaggagagccagtgtcagtgatgcaacacgaggtatctgactggctgtcactggttttggagcttgaagttagccatatgtattagtctgttttcatgccgctcataaagacatacccaagactgggtaatttataaagaaaaagaagtttaatggactcacagtcccatgttgctggggaggcctcacaatcatggcagaagagcaagggacgtcttacatggcagcaggcaagagagaacgagagccaagcaaaaggggaaaccccttataaaaccatcagatctcatgagatttattccctaccatgagaacagtattggggaactgcccccataattcaattatctcccacaggatccctcccacagcataggaatcacgggaattctgggagctacagtccaagatgagatttgggtggggacacagccaaatcatatcaccatgaatcaaggactgtgagcagctcatagaagctggaaaaggcaggaaaacagattcttccctagagcctccagaaaggaaagcagccctttctatattttcgactggtagggcccattctggacctccagaactgaagaataatacatttgtgttgtttttttatgccactaaatgtgtggtaatttgttacagcagcgttaggaaacaaatgcaataatataccagcagaaggcatcacacagggaggcatgggctaagagaaggacataaaattggacaccagtgggaaaatacaccttatcattttgtactgactcagtattttaaagatggtgattctttctcgtttttaaatgtaatacaataccattgcaatacagtttccctccaactccaacttagttcttgacaagtaagcctaaagtgcatttggaaaaataaatgtgtgacaatagacaggttatcaatttgaaaagagaaaggtaatggagggagtggagatcaacctttatcagatatttatgtaaactacaaatggttctggtacaataattgaaaggcaagataacagaaaaaatactttaaaagaaggttctgatgcttgcagaaacttattacattataaaggtggtatttcaaatcagtaagaaaaccacgggttatataataattgtcagtgaggtaaccaactagtcatttagagagaaataataaacttgaattactactgcattccttatatcaaattaattcctgataaagatttaaacaattagcaaatatatttgttataataatcttgaaataagaataacttttgaccagaagctacaaccagacacataaccaaggttgtacagaaaaagattgataaatttgaatatatactactattaaatttgtataaagaaactaaaatatcataaagatcaagagacaaaaaatttgggaaaattctttgacaaatataacaaagggttaatctctttaatatatataaagataataataaattgagatgaaagagaccatcaacctaagagaaaaaaatgagcaaagattacaggcagttgtaaaaatagctagaaatttcttacatgaaaagatgctcaacttcatttataattaaatatatgtacatgaaagcaagataacacaccattcttgatcaaattgctgtagataatacacagtgttagtgagggtttgaaaaaaatgggcactttatataaaagttaaaagactaaccatctgttagtcaaagtgtgaattgatgtaaacctctttctggctaatttgtcatttgttacaggagatcgttagaaagcagatctttagacagcatggactttagaacttttgccatgttaaaatttttccctcacctcggaacaggtgggattgataaactaccattactatttctaaaacatggtactgtaaagcaccatttacaggcattgcataattattactctatctaaaaaatgctaaatgctggatatgctgtatgtttctattaaataataaaatgggagtgtgggtggagggaagcctgcctcttggtgtcatgcatgagaaaaactaatcagatctcaccaatatcaatcgtctgagctgtgaatgggtgtcgggatagcatccctctttagaagttactgatgaaaccccatgaagcttgattcttagataagccttgcttggtcagccacttcaaaattggaggtaccaatttaacatttgaaaacaaaaaatctcaacaacaaagttctgagaaaccagtgtgggtactacctaagaatgttactttgggtatgatatgggttaaactatgtcctcccaaaattcacgtgtcaaagtcctaaccccagtacataagaatgtgacattatttagaaatagggtcactgcagatgcaattagttaaatggagatgaggttattagggtggaccccaatccaatgacaagtgtcgttataaaaagaagaaatctggagacagacttgtacacaggtataacatcatatgaagattggagttatgctgccacaagccaagaaatgctaaacattgtcagaaaaccaacaggaatggaacaaattctctctcacagacctcagaaggaaccagtcctgctgacaccttaattttgaacttctagcctttagaactgtgagacaataaatttctgttaaggtatgcagtttgtagtactttcttatggaaaccctagcaagccaatatagagttaaaaaaaacagtaaaaggtactcgttgaaaaacttttgattaatctcttagcattttaacatatttactccttgggaaaaaaataacaattagggactatcaaaaaaggggattatctttcttcttgataaaattcccaaaagtgtaataggtatcaaaattttaaaatcacgtaccctttaataaaataaataagtattgttgctgtaaacaggcaatatagtacaatatagaggtctacagactttagactgcacaaagtccacctggatcacttgttagtaatccggatttgtggctctccccggaattcttactaaatcggaatctctggtggtagccatggagagttatatcttacaattatcccaggtcatgttgatgcaaattgttggtgaaatatacttggaaaatacaggaagagtagttcaagagcatgagccctttaactggagtcagaatcccaactctgccttttttaacaaagttgccttggcaaagtcttacagtttcctcatctgcaaaattagaatagtaatagtatctgcttcaaggttttgttggtagttgtgaatgaaataataaaatcaataaataactttgattaaaatgtatcaaaccaccaatgacattcttaacataatgagaaaaaaactattttaaaattcatatgggaccaaaaaaaaaaaaatggcccaaatagccaaggcaattctaagcataaagaacaaagttggaagcatcacattacctgacttcaagctatatactacaaggctacagtaaccaaaacagcatggtactggtgctacagtagacacatagacaagcagaacagagtagagagctcagaaataaagccacatgtctacaaccatttgatcttcgccaaacctgacaaaaacaagcaacgggaaaagtactccctattcaataaatggtgctgggataactggctagccatatgcagaaaattgaaactggaccccttccttacaccatatacaaaaaatcaactcaagaaggattaaagacttaaatataaaacctaaatccataaaaaccctggaagaaaacctaggaaataccactctggacatagaactagacaaagatttcctgatgaagatgccaaaaacaattgcaacaaaaccaaaaattgacaaacgggacctaattaaactaaagagcttctgcacagccaaaaaacagaacaaaaacaaaaacaaaaaaaaaaacaaaaaaaaaaccatcaacagagtaaacagacaacctacagaatgggagaaaatatttgcaaagtatgcatctgacaaaggtctaatcccaaatctataaaaaacttttaaaaaattacaagcaaaaaaaccaaacaaccccattaaaaatgaggaacataacatgaataaaatgattcatttcaaaaagatgattcatttcataaagcacttagtctagtgtctaaaagcctaagtgatcaatcaatgtagccattattactactcagtaatttttaaaatgagataaatgtgcaagtactgatatgttaagctaaaacaataaacaaagggaagaataatatgtgatgtatgttcatatctgtgtgaaaaaagtatgcactcaaattatatattcctggaatatttctagaagatattattagaaacatttggtgtttaacactgggaaatgagatcatattctcttttgctttgcttgatttaaaaaaattatatgtacatgtgattttcagggaaaaaatatagtttgtgaatctaccacctgaggaaagagatgataccatttcaaatacaaatgagctttgatttttatttctggcactactgtgtagaaatttgcataccccaggtgaaattggaaatggtgaaatcccaagaataatctctgtaatgaatcatacaaatgcaactgaaaacatgccaaatgtcaggtaaaactaaataggaaccacctttgtacaaatcctcaaaaaaagacctagatgatctagatcagaagtcaacaagaagtcaaaagaagtggaatgtagttcaccaataagaagatgacaaagaggagaatgttcacctagactcgaacccttgaaccatttatctttctcttgttctatcatgcttactgtttctgtaaagaagccatcaacaagttgggcgtattagctcacacctgtaatcccagcactttgggaggctgagatgggccgatcagctgaggtctggagttcaagaccagcctggccaacatggtgaaatgctgtctctactaaaaatacaaaaatgagcagggcatggtggcgtgtgcctgtaataccagctacttgggaggctgagggaggagaatcacttgaacctgggaggcagaggttgcagtgagcaaagattgcaccactgcacaccagcctggtgacacagcaagactctgtttccaggaaaaaaataaaagaagaagtagtcatcaacttctgtaagcttttcacttcctaattacccttaaatccacactatttttctacgtccataatcactaagctagttcaagcttcatcagctcatacctatgttacatatttaaataatctccaaactcccatctaatttagctccattttaaccaggagttcccatcattctgaatactaaaacatttttttcgaagtaaaaatttttacagattctctaagtgataatattaggattaatttaggaatgtagacagtataataaatgactttcttatttactctctaaattatagataagagtccagggttcaagaaaccaaccagagattttaaacatttaggctttgcaggccacatggtctctgttgtaactactcagtattggtgttgtagcacagaagcagccacgtacaatatgtaaatagaaaagcttgtccagatttggcctgcagtgagtcagaactgtcctagtgaccacagattgccagactgtggcaaagaggtcatgcaaaagagtttaaaacatcagtaaggctagtgatgaagcagatactggtttaggcccttggcagtgtaggcttcctactcctacactctagaactacatagactggcatcaggtctcccaagcgagttctttattgctaggcttaccttacatactttctgcaggtgagaagatcacaaagagaataagtgacacaagctcagtttctgctcccaagtttaggagtcagttaacttccctgagaaaagaacaggaacagagagaagcccagtcacacttatccataactctccacgtgaaaatacaaagtcaggggaaagaatctcactttccttgcccaactgcaacaggtaagttgtaccactgtattaaaaaaatcagcaaaaagcaaaagtgattttccatttttattaatcacaacaaaacttatgcaaattttaaaataataaatatggacatggatatgtaaaacctaccatttatttaatctacagacagaggttagtatctgtatggattttcaagcccttttcagcaaccccatagtggcccacttgagatccacagcttcataccacttctaaaaggtagggactattataaccctcacagtatagtactgtcagaggacaatcatgatcatccaataaatatttgttgaataaaaatatgaattttatactaatttattctttaaagctttcaaagcctctccaaggataccttttaatacaaaccctctcttcccatatgcctgatatactcagtagcctccatcctgaatgacatattcctgcctctgtcttcttgcttatgttctccttattccctctgagtagcagggccctcccaggcctatagaaattctccctttccttcataggcaatcataaattctacttagtccagtaagaattttgtggctacacttgactacatagcttgctttcttctctgaacctaaaaacaacagtaatattctgtttgatattaaatcagtatctcatgacacattagcttttcaggactgcatttataatcaatatttttattgttagctacttttgttgttgttgtagtatacatttttatttttactttttatttcaatagctttaggaatacaagtgttttttggttacatggataaattataggaacctcccaactctccccccttctgagtctccagtgtcaactacaccacacagtacacctttgtgtacctataacttagcttccaattataagtaggaatatgtggtatttggttttctatttccaagttacttcacttaggataatggcttccagttccatacaaggtgctgcaaaagacataatttcattctttcttatggctgagtagcattccatggtatatataccacattttctttatccggtcatcagttgatgggcactgagattgattccgtatctttgcaattgtgaattgtgttgcaattaacatatgagtacaattgtctttctaataacttccttttctttgaggaaatacccagtagttggattgttcaatagatggtagatgtgcttttagttctctgaaaagttgccacactgttttccatagaggttttactaattcacattcccaccaacagtttataagcattctcttttctccgcatctgaaccaacatctattgttttttgactttttgaaaatggccattctgactagggtgatcttgtagctcactgtggttttaatttgcatttctctgatgattagtgatatcgagcatgtgtttgttggccatttgtatgtcttcttttgaaaaatatctgttcatattgcttgtctactttgtaacgggattgtttttttttttcttgctgatttgtttgagttccttatagattctgcatattagtgctttgtcagatatacagtttgtggatattttctcccattctgtaggttgtctgtttactttgtggattatttcttttgcagtgcagaagctttttcatttaattcaatcacatttatttttgttttgttggatttgcttttggggtctgtgccctaaattatttgccgaaggcaatatccagaagagttttcctaagttttcttctacaatttttatggtttcaggtcttacatttaaggtttttttgttgttgttgttgtttgcttgtttgtttgtttttgagacggagtctcgctctgtcgccaggctggagtgcagtggcccgatctcggctccctgcaagctccgcctcccaggttcacgccattctcctgcctcagcctcccgaatagctgggactacaggcgcctgccacccaacctggctaattttttgcatttttagtacagacggggtttcatcgtgttagccaggatggtctcaatctcctgacctcgtgagccacccacctcggcctcccaaagtgctgggattacaggcgtgagccaccacgcctggtcacatttaagtttttaattaatcttgagttaatttttatacatggtgagagataggaatccagttttcattcttctatacgtggctattccattttctcagcaccatttattaaataggatgtcctttccccagtgcatgtttttgtctgcttagtcaaagatcagttggttgtaggtattttgctttgtttctgggttctcaattctgttacatttgtctctgtgcctattttataccagtaccatgttattttggttactattatagccctgtagtataacatgaagtcaggtcatgtgatgcatctagatttgttctttttccttaggactgcttttgctagttaggcttttttggttggttccttgtgaatttttggattgtttcttctaattctgtgaagaatgacattggtattttgataggaattgtattgaatctgtagattgctttgagcagtatggtcattttcacaatattgattcttccaatccataagaataggatgtttttccatttgtttgtgtcatctatgacttctttcattggtgttttgtagttctccttggagagacctttcacatccttggttaagtgtattaggtattttattaatattatattattttgcagctattgtaaatgggattgagttcttcatttcattttcagcttggtcattgttggtgtatagcagtgctactgattagtgtttatgttgattttgtaatctgagactttagtgaattcatctatcagatctaggagtcttttggaggagtctttggggttttcaaggtataagatcatatcatcagcaaaagaagatagtttggcttcctcttttccaatttggatgttctttctttctcttgcctgattgctctggctaagacttccagtactgtgctgaatagaagtgatgaaagtgggcatccttgtcttgttccagccttcagggagaatgctttcaacttttccccattcagtatgatgttggctgtgggtttatcatatatggctcttatcattttgaggtattttagctactttttagattctaccctcccagtgagctagtgctccatttggtgtttcatttgtgtgtgtgtgcacgcttctattttatgcttcacagaaatccatacaattcctacacagagtagactttcaaaatattgaattatttatgttaaatgactcaattaattaacaaaagaatggataaataaataacataaatgaccaatattaataaaaattaagtcttaaaaatatggagaaaaacttgaatggcctcccaaaaccttccaatccctgtgctattttaacagaaacattaattatttttaaaaaaccctctttgtagtcatttacttcacagagacaagaaatatggtaacataaaggtaaataatataaatctgtgacttgaatccttgaaaaatctggaacaacaaaaatattgacaaataatatcattgtttaaaatactgaagaagaatatattgcaatgacaatatgaaaatatgttttggtatctccagtctcagtcttgttagaagtatgttcagaagtgaacaactgaatgagaagtgaagtgctcataggggaaggataagtccagaaatctgaatttagtcccacatagcaatgaatgtttctcaattatacaaattacagtcaccacttcagtgataatcatgtcatttgccatttattgttttcactcatcaagggataaagaaaaataaaagatgaaagttacttgaaaaataatgatgaatccatatgctgagagaaaagcattgtgttctaaatgacaaccaacacctgaacccaggactcacttatttggttaattaatatacattcgaggctgtgaaattgtcatttctacacataataattaaacaccattaatggaaacacctaaaataactacatttgctttctcagagaattacacattaggaaagtaagttaatgtgataaacattttacaatatatttagacttttaggaaactttttttttcttttttcttttctttttttttttttttttgagatggagtctcactctctcacccaggctggggtgcagtggcattatttcggctcactgcaagctccacctcccgggtttaccccattctcctgcctcagcctcccgagtagctgggactacaggcacctgccaccacacccggctgattttttctatttttagtagagacggggtttcaccatgttagccaggatggtctcgatctcctgacctcgtgatctgaccacctcggcctcccaaagtgctgggattacaggcatgagccaccgcgcccggccctttttaaaaaattaacgtgatttaggaggccacttgaagatattcagcttttgatggcataaaattctggctttaataaccaaccactagttatttaatatgattgtgtacctgcaaaaagcttaagaaacttttagctaaatgaaggaattctttaagaagacaaaataagaattagtcacatatctgcttttccactattcttgttaccattactctaccagcatccctgcaaagcagatcagcaatatttgtgtgttttgaaactcctctggtttcctggcttctaagatccagtccatcaccaagtcccatgattggtccactcttgttgtcccacgtccatgttaaactaggtttcagcatcacacatgcagattaatgtcactgtctctgaactcatctcccttcttggacagcttcacttcatcctatataccaccattagaagaatctttgaacacaattattctcaaattattcctagcccaaaaactcaaatactttctaaataaattttattcaaatcaaaactctctagcatagcgctgtatatcccaacatgccaatttcaccttctttatttcattttccattcaactgtatgccaaggctctactttgagctcatctgcttgttagatcagcttaacactgaatttgaacatgccttacctcacaattctacttcttcaagttcttcacctattttaaaagccagtgaagaagcacttacagaggtagaataagaatctccagaactccactccttcataaaaggcacaggaacactcaaaaagttgtcaaaataaactttagcacttaaccaaaggtttgcaataatccatcaaggatttattcaagaaaatcatcagaatttttgtgaaaacagttaacattgtgtatttaaatttgctctaatcccatttccatctccccagctccacaacagtctcacaatcactcttaaaaccaacatatactagagggcgttaaatgggtttggagctctacaaactgtcttgcactcacagagaattcatatttgatgtatgcagcagctccctggaaaagctccatttataggacatgtctttatttgacctgatacagaactcactcagtgggaaaggctctgttcttaagatgttagtcaaaatcaatcctgacccatagaatgtacatcaagaatgaaccctaatgcaaactatgaactgagggtgatgatgatgtgtcaatgtaggttcatcaattgtaacaaatgtagcactctggtggggatgttgataatgggggaagctacacatatgtatgggggcaagggagatatgggaaatctctgtactttcctcttaattttgctatgaacctaaaactgctctaaaaaattagtctttattataaacaaaactatgtatttttctacaatcaaatttcttcacagctatatgttcttagctcctttcatgcttttatgtgtttgtataccttttgtgttccagtggttgggaatagttttgtgaaaataaaaaatatttccataaagaaaaaaagctagaaaagttgttgctattagacctactctataagaaatatgaaatttttattttaatttaaattttgtgtaggtacacagtaggtgtatgtatttatagggtacatgggatgttttgatacaggcatgcaatatgaaataagcacattatgaagaacggggtatccaatccctcaagcatttacccattgagtttcaaacactccaatcacactctttatttttaaatgtagagttaagttataatttattatagtcaccctgttgtgctatcaaataggtcttactcattttttctaagtacttttgtacccattaaccctccccaccttaaccacaaaccccacactaccattcccagcctctggtaaccatcctccaactctctatctccatgagtttgttttgctttttagatcccacaaataaacaaaaacatttgaagtttgtctttctgtgcctggccaatttcacttaacataaagatctccagttccatccatgttgttgcaaatgacttgtctagatctcattatttttatggctggatagtactccattgcgtataagtaccacattttctttatccattcatctgttgatggacgctttggttgcttccaaatcttagctattgtaaacagtgctacaataaacataggagtgcagatatctcttcaacatactgatttccttttctttgggtatatatccagcagtgggatcgctggaccatatggtagttctatttttagttttttgaggaacctccatattatcctccataatggttgtactaatttacattcccactaacagtgtataaggttttcctttttctctacatcctcaccagcacttgttattgcctgtcttctgaattaagccattttaactgggtaagatgatagctcattgcagttttcatttatatttctccaatgatcaatgatgttgaacaccttttcatacgcctgttttccagttgtgtatgtcttcttgtgagaaatgtatattcaaatcttttgctcatcttttggcaaagttattttcctatagagttgttcgcacactctatatattctggttattaatcccttgtcaaatgagtagtttgcaaatattttcttccattctgtgggttgtcctttcactttattgattgtatcctctgctgtgcagaagctttttaacttgatgtaatcccatttttccatttttgctgtggttgtctgtgcttatggtatattgctcaagaaatttttgcccagaccaatgtcctggagaatttccccaaagttttcttatagtagtttcatggtttgagggatttgatttaagtcttaattcatttttatttgatttttgtaattaatgacaaataggggtcttgtttcattattctgcatatagatatccagttttcccagtaccatttattgaagagactgtcttttccccagtgtatgttcttggcacttttgtcaaaaatgagttcactctaggtgtgtttatttgtttctgtgttctctattcttttccattggtctatgtatatatttttatgacagtgtcatactgttttggttattgtagctttgtagtataatttgaagtcaggtaatgtgattcctccagttttgttctttttgcttaggatagctttggctattctggtttttttgtggttccatatacatttttggattatcttttcctatttctgtgaagaatgttattggtattttgatagggatttcattgaatctgtacatttctttgggtagtacaaacattttaataatattgagtcttccaatccatgaacacggaatgtctttccatttttctgtgtcctcttcaatttctgtgtcaatggtttatagttttcatcatagagatcattcacttcttttcttaattcatttgtttttaatcttatgtgtggctattgtaaatgggatatttttatttctttgtcacattgttcactattggcacacagaaatgctactgatttttgtatgttaattttgtatcctgctactttaccaaatttactagttctaatagttttcttgtggagcctttaggtttttctaaaatcatatcacctgcaaacaaggataatttgacttacacctttccaatatggaggccctttatatctttctgttgtctgattgctcttgctaggacttccagtactacgttgaataatagtggtgacagtgggcatccttgtcatgttccagattttagagaaaaggctttcagtttttctccattcaatgtgctactagctatgggtctttcatatatggctttaattatgttgaggtatgttccttctattctcagtttttgagggtattttatcacgaagagatgttgaattttatcaaatgctttttcagcatcaatcgaaatggtcatatggtttttatccttcattctgttgatatgatatatcacattgatttgtgtacgttgaatcatccttgcatcccagggataaatttcacttgatcatgatgaatgatagaaatactaaattattaaagggaggctttctggctgaaaagacagtaaacagtaatgcaaattcacactaaaaaacgtaaaaagtgtgggtaaaggtaaatataagatagtataaatgtacttttatttatactcttttcaccacccttatgccttaaaaaatcaactgcataaagcaataattacaaatctctgttgatgtgcttatatgaagatgtaatttgtacaaaagcaacaatacaaataagggaggaggaaatattggggcaaagtttttttgtatattattgaaacaaactgttgatattaattcaaaatagattattttaagttaaaaaatcaattataacctctagaataccaactaaaaaataactcttaaaaatatgtatgaaaaacataaaggaaattaaaagaataaactagaaaatatctatttaatacaaaggaaggcagtaatggaggtatagagggacaataatgatataagaaatattagaaacaaatagcaagatggcaggcataaatactaccttatcaacaattacattaaatgtaagtagattcaacactccaaacaaagagatgagcagaatggactcttctgtttttgtttgttttaggttttgcttttttgttttcttatagacagggccttgctgtgttgcccaggctggtttcaaattcctggcctcaagggatccttctgcctcactctgcctgccacaaaatgctgagattacagacaagccactgagccaagccagataaattttgttcaaaaaatgatccacatgttgtccataaaagatacacttaatattcaaagacattaataggttgaaagtaaaaatatgaaaaaaagatacatcatgcaaataacaaccaaaagataacttcagtgactatactaatattgaacaaatagactttgagacaaaacttgtcactagagacaaaaaaaaagacattttataaagataaaacagtcagtcaggaagacacaacaagcataaacatatatacacctaaaaatagggcctccaaaacatgaaacaaaaagtaacagaattgaagggagaaatagacaattaaaaaataatagttggagacttcaatatcacattttcaataatgaatagaacaattaggcagaacatcaaccagcaaacagaagacttaaataataccataagccaagtagacctaacagacatctatagactactctaccaaacaacagcagaatgtgcgttcttcttaagtacacgtgaaacatcctgcagaatagaccatgcaatatgagacttgccataaacaagtctcaatacattttaaatgttttatgtcatacaaggtatgttctctgaccataatagaaaaaaattagaaaacaataaaaatgaaaattgagaaattcatgaatatgtggaaatagtcaacatgctccttaattagcaatgtgccaaagaagaattctgaagggatattaaaaataatttcaaatgaatgaagacaaaaacacaacataccaaagcttatggaatgccgcagtgcttagagagaaatttatagctgtaagcctatttttaaaaagacataagtcaattataacctttagtattaagaaactagaaagaaatataaattgaaagcaagcagaaaagaggaaataataagagcaaaaataaatgcaaataaagaatagaaaaacaataaagaaattcaaagaaatgtaagttggttctttgaaaaaaaatacaattgacaaaatttcaggtagactgaacaaaaaaaaagagagagaagactcaaattactaaaatcaggaatgaaagagaagctatcactaccaactttacagaaataaaaaagtttataaggaatactatgaataactccatgccaacaaaacagataggctagctgaaataaacaaaatcctaccaaaactgacttaagaaaaaataaaaatatctgcgtagacctataacaagtaagagattgaatttgtaatttcaaaactttccatatattacggccaggctcagatggcttcaaaggtgaattaaaccaaacatttaaagaagacaataacaatccctcacaaatgcttctttaaaaaaaacaaacaaacaaaaaacacaaaaaaggaaacactttcaaattcattttaggaatcttgtattacactaatatcaaaaccatataaacacatcacaagaaaagtagacatcaacatcccttataaatgtagacacaacaaccttccacaaaatgctggcaaactaaatgcaacaacatacaaaataattatatatcatgaccaagtgcctcaggaatacttggctggttcaatatatgaaaaatcaaccaatatcatacactatattaatagaataaaggacaaaatccacaaaatcatctcaacagacacagagagtgcatttgacaaaatgtaacatgcttctggtcgggcatggtggctcacatctataatcccagcactttgggaggtgagtgaatcacctgaggtcaggagctcgagaccagcctggccaacatggtgaaaccccatctctactaaaaatacaaaaattatctgggtgtggtggcagacacctgtaatcacagctacttgggaggctgaggcagaagaaccacttgaacctgcggagcggaggttgcagtgagccgagatcatgccactgcactccagcctggcaacagagcgagactccgtctaaaaaaaaaaaagagtaacatgcttccatgataaaagcactcaacaaactagaaagaatgagaattctctaaatctgataaaggcgtctatgaaaaacctacagctaagattctatttaatggtgaaaaactgaatatttccccctaagatcagaaacaagaaatggatgtcactcactatttccattcaacattgtactgaaggttctagtcagggcaatagataggaaaaacaaacagcatccagattggaaagaaagaagtaaaactatcttaatttgtagatgacatgaacttacatatgtagaacaatcctaaagaagccacaaactttatttgaaataatggacaagttcagcaagtttgcagatacaaggacaatactaaaaaaaccaattgtatttctatatggtagtaatgggaaatgcaaaattaaatttaaataaaatttcatttacaatagaataaaataaattacttagacatgaacttcacaaaaaaaatctaagatttgtacactaaaaatttaaaaacatagttgaaataaattaaagaaggcataaataagtggtaagacattgcatggtcatgggttagaagacacaatattttttaaatggcaataatctccaccaaattgatcaacaggttcatcaaaatccctataaaaaaaatccgtggtgctttttttcacagaaattgaaaagctggttctaacatttatttatatggaaacagaaggaactcagaatagccaaaaaattttgaaaactttgaacaaagtgggaggagtcactcttcccaatttcaaagactactaaaaagctacaataataaagacagtgtggtacagcataagaatagtcatatagatcaatagaaaaaatagttttttcaacaaatggtgctgggataactggatatctatccacatgcaaaagaatgaagttgaatacctacctcatataatgtacaaaaatgaactcaaaatgaatcaaacgcctaaacgaaagggtaaactctacaaaactcttggggaagaagtatagataaatcttcatgaccttggatagggtaatggtttcttagatataacaccaaaataacaagtaacaaaagaaataaataaactgaattttgtcaaaatttaaaacttttatgcttcaaaggacatcaagaaagtaaaaagacattcacagactaggagaacgtatttaaaaatcatatatttgatatgggacttgtattcagaccatatgaagaactcataattaacaataaaaagacaaattatccaatttaaaagtgggcaaaggaataagtatttctctaaagaagatctacaaatggccaataagcacataaaaatactaaacatcattagtcattagagaaatgcaaatcaaaaccacaataagaaaccacttctcaccactaaggtgattaaaataaaaaagactaacaatagcaaaagttggcaaggatatggaaaaattggaaccttcatacattgctggtggtattgtaaaatagtgtaaccactttggaaaatagttcggcagttccttaaactgttaaatatagagttaccatatgactccaatattctacctctagttatatataacaaagaaatttgaaaacaaatgttcatacaaaaacttgcacataaatgctcatagcagcattgctcaaaatagtcaaaaagggtgaacaacccaaatgcctaccaattgatgaatggagaaacacagaattgaatattattttgtaataaaaaggaatgaagtactgatatattttactatatggataaattttgaaaacattatgctgtgatacattctacaacataaataaactttaaaaacattatgctaagtgagaaaaaaacagatagaaaaggccacatattacacgatttcatttatatggcatatgcagaatagacaaattgataaaggtgtatgccaacttagtggtagaaaaaaggaaggccaatatgggacaccgaagctaataagacatgagtaggattaaattttcagtctagtaacacatgaggaatgcctgtggcaaagcaagaccaagataaatgacataagaagacaaataaaattgcaacttcactgggaatgagatatggtagttgaatttgaagattctgccactatgtttcacaaaatatatagagagaaacatatataaatacatagacatatgaacccctgtgaaattgtgtgttgtaagaaaaagaaaaataataaaattctttaaaaaaaaactaccttgtgtttggattgtgccaaccaccacatggtaatatctgaataagtctgggtaatatgtgaatgagcatacagtttgttggcatgaacaaatattgaaatcaataagttataccagttatgaagtatttcaattctcactcctgattctgatatcagtgacagtcaatgtagtaggtttttaaattccaatctgccttaggtgttcagatccattttctggagcaggtttgaagtctgacagtccctacccggactctggttcctatgctttattatgtgcagcaagtcactgaaactgcgagatttcttcatgtataaaatcagaatgataatatgtttctcaaaagtttgtttcaagaacgaaacaaaatgtcctgtgtaaaagatctaataccacttccagaacacagtatgagctttcttttaggacagcttcattgccactgcctatgagctgaactaagcatttcatgacaagagaccctggaatataaggagtctacaaacacctacattatttagtcattcaggatgacagaacaagtgacaagagcaattgttcccaaccttagctgtgcatgtggaacatctgtgaagctttttaaatgcatataggtctgagactcacctcccaacaaccctccagcacctggtcccatgctgataacctttcttctgtataaagtcttacatagttttcacaaatactatttataaaaccctcagtgttttcttcttctggctaaaagtgcctgctgttttaactcttccactgcaaaacactgtctaattattggattattcttaaaactcatctgtgagccctggctacattatctgactgtctctttggttatgtggcttcatttatcattggtcgaacttactggaagtgaaaaggaaggttaccttaattgatagagctattgatataattctaagatatgattaattgcacaggacattttaattatatgatccgttcttcatgagacaacaaaaaccaaggcattctagacacccatgagggagctctatttctatgtctgaaaacgaaattagacttcttgcttttatttttcccttcccaaatgacatttatataacacacttaagttctgatggagtatggcaaatgtatttaactttcgaccaatatttatagaatcctttatttcataagggataaaagcaagcccagaatttttcctgtcttttaactcttgaaattgtcccctaagaatataaacaaactaaaaggcgaagcaaaacatagacaatatccccttgaatgattcataataaccacatttaagcctctctgggttttgtttgtttgtttaggtcacagcactattgggaggcaaaggggttattggctattgaagtgtttgctgttgatgaagaactaaatttaaggcatgtattcttttcttgactagagtttgattagcttcgtcatacttttgctttagggaaagaatggtatagaagaaataaaagaactaacggaagcccttccatttcaatcactgtaaagaatttatcatcataagatcaacaaagcaccatttccatgtaccttttgcaatatatatatacacacacatatatatatattttacacatatataaattatatatatatatatataaaattattgcatcggggcttctttgttgcttttctttttcctcaatgacattgagactttacctatatccaataacatttgccttcctttctattttcttgcatgttttaatctcatagtgtcacatgggttcactttacctaaagatggaatattctcctccgttggagaagaaccccaaattaggccagaagaatactgaaaaatgtatggactttgtagtcagaacctgggaagaaaaatcctaactctgccagatgaaatggtccaagtcaagttgaatggaaggattaaaatagaagattaataaaatgcagctgtagacagctggcacatagtgacagtcaataagtgacaatttataattcattcatttattctacctgcctggagaagtgaaatctaagagaaatagacaatagaaataaaatacaaatctatcaaataaaacaaagtgaattaatcagtaagcattcttgaacactaatatatataaggaagggctaacttaagaaagacatgcttttcaagagtttataaactggcttaccattttaagacattttccataaaaattatgccacatcatataaattagtaaaactctattccaatcttaacctacttgtactctatgttctagtcactctagaagtcctaatcacatgccaaaccatgccacaagtttccagggacacatttcacatatctgctgctctcagtagagggatcaataattcttccctactgggctgcagagcgaagaaaatgggatctctgataagtacaggcaatcaatccatgctggtgtccactgcagaatttaggaactccatgaaatcaggagtaagggaaggctagaccaccctctgaaaactgaacgttaagggttctactttatgcatgataaatacatagagcaaagtgaaagaaatcagatggagtctggtcagaacgaatggaagggaaaaatagttaactataacaggattgtgagatggtctagttctagtaaggggaaaggagctcagtaaggttggagaagtaggcatcaattagttccagggtacatgcagtgtagcaggttgggataaactccaacaacaaggagaactgattattttagcaagaggaaacaagacatctctgacaggggcagggggaggatgaataaacaagaggatgagtgtctggattaggctgagatccctacagcagtgggacactgggtggactctggggggaaatctgtggtaaaattcccagtaagtgtggccttggggagaaaaagagagggaaattccaagaacaaagtacttgggttttggagtcagaccagggtttgcatctgagtttgcccctttactttctagatcttagacttgaagcaagtcacctaaccagtaaataatttcttaatcacacaactttgtacaataatgcctacatcaaaggactcttctgaggattaggagataacatgtgggaaatgcctggtattgttcagatatactttgtttttattttcttttattttggtataaaatataagttcttactataagaagtttatctttctgatcaggagagatgatccaacccctaattcataaaaaagaaacaggaggaatataggaacttaaacacccaggggtgttatgaggcaccagccctagaaagaagttggaggctgaaattttagccccaactctaaagcaaagcaataatattgtctgggagctgaatccacccaaagtgaggtgcccttttctaatcctttcaaaggctctatatgggataatgggtgatcctgaaagtgtctccctaggaggtagaatacaaactactcaactgagtggcaaaacctttcatgttcaacatatgtaacatttcagtcttaaatgttttctgaattgaaccgagcattattcaggaagtgaaacactcccatgtcttgggaatacattgttcaaatagtctaaaacatcaggtatgttttattttctttttcacattataactccctgaattatattccaaaggtagaagagtttatgctagatttttacagaggatgtcttcatgcaaaattaagggattgcagactacaaaactgttggcagaagattcgggttgtttttgaggaataaatgtatgcccttccctgatgctgtcttatatggcaataaactaaataaaaattgtagttgattgacagtaattataaacctgcaacagcaataaaatttgtgttaattatcaaaaatatcagaccagttgtgctgcccattacagaacaatattgaattttctgttaaggaaattggtccacctttccctaatttttgttttgccttcctaaaggtaagcctgaaatatataatagcatatcatcagaattcattccactgactccactaaatgacttccagaaattttgctataggttgctaactaaagacagcagcatctccttgcatggaatatcagattcaaatttctttgcctgattctgggtggctctctaccaaatggccctttcccttttcctgttaactgttttgctttctaatccccaacagtttagcacattaggtgctcaataagtatctgtggaaagaaagaaggaagaaatagagagatgggcaggactatgaatgtttttttaaagacaatagaaatccccccaccaccattctacaaaataccttttgcatctgacaaatataggtaatgttattattaataatatattatttcagatattaacttctttaaaaatgtaaatcttcttggagaatcaacatttagtaatgtaatttactcatccatgccacactaagaagaaattttgaagccagaaaaagagagggtagtagaaatttgaaaaagaaaaacaataagaaaaggagaactctggaaaagatagtgctctttgcctttgtttttgctaaatatattcattcctttgatgaaccattaaaaaattattagctcctatatatcttagggatacagacattcagtcattagaagttgcgaagatcatcattccacaaatattactgggttcctgctatatgccaggtgcataagtgtagggaacaagattgcctacccagaattatgaaaccaaaatagataattacaactatgattaatgcaataatggagaactgccatggggacataacatataacaaaaaggcatactagtggggaactggaggtgggggtgactagcaatttacctatatcttttttccaaaatgatcttcaaactagaaatataagatcagttaacataaagaagaaaccgaaactctagataggtcatacaatagttagagagcatcaacccatgtgaacagtcaagtctccagtccaggtatactatacctcagggcactaaaggaacatacatattgattactgtaaataacttctgtaattctttagaaatcacagtaagcgtgatggcagaagactggagatgggtaaatctttaatccaattttcaaaatagaagttgaggcaaaagactaggaagtttaagatcagtccctgccaaaattcttagagttaagcagatggtttttgaagtcttagtaaataaactggtattcatgaaaaccaacagaatttgctaaattaagttatgctaagatgaatttattttattcttcttcattctctttcttccttcttctctccctcactcttttctttctatctttcataatttctgttattcaacaagtgcttgtccaacactttcatgaatgctttacatggaatgcttgacaagcaagctgttaaccaaaccagtggtttgcttagtaatagcaattagatattgcttagtaatagcaattagataaaaactaatttgcctaaggaacatgcattctatagtcaatgcatgaactaacctagttcagtgaatgtaagataaagaagatcctgttagcccaacattttgtaaactcccgccattccacagaccctggtcacagtggaaaattccactaaggcttgggctgtgaaaaacatcctgctggataagtcccaggcctaactgcctaactgcagaaaattcctcccttttcagcagctaacctcactgtccaccccatttcacaacaagcccagacccctcccgctcggacctataattactccagcatgcaaatggcagcgggctccagcgctagctggtatccccttctgcaggtcttttgtccaataaacctgtgttgttgttgagccagcaactctctctctcttttaccctcgccttcccttcaaagcctaacagatccctagtggtttcatggtgctctctatctatcttgagtgctctctatcttgagtttccagtgtaacatttctctcagtgtcttgataaagtcctaagaatcacagacatgttgtttacataaagcatagaaacataactagcacttgtgtcaaaatcataagggctgcttgctcaaaattcaaattcctacctatcccacagatatatttagtcaaaatttccaatcaagcgcggtggcttaggcctgtaatcccaacactctgggaggctgaggcaggcagatcaattgaggtcaggagttcaagaccagcttggccaacatggtgaaactccgtctctactaaaaatatacaagttagctgggcatggtggctggcacctgtaatcccaggtacttgggagactgaggcaggagaatcgcttgaacccgggaggtggaggttgcagttagccatgtttgggccactgcactccagcctgggtgacagagtgaaactctatctcaaaaaaaaaaaaaaattgaagtttgaagttatgtagaaatttttatttttaacaatcaccacagttatttattttgcacacttaggtctaagaaccctcactgaaatgtttaagacacattacctacccacaatcactaactaaccccatgtgtatagggggcctaattaaaatacaacaacaactataaagcttctgtagataaatgctaaaagatctcaaagatttgagggatcttccttatcctgcaatcccttttggtcttgctgcttatccttgattatcttcctctgctgcattcttttctttgatcattaatttaagtgttatgctctaatttgtttttaatttggatgacccctctgtcctaaggatgtgttttggtaaaaccctggcatcctactaccagctctacttagactccataattaaccctacacaatccctgacctctatgtcccagcctcctggaagcacctgacaacaaatatggaatcaagaaattgtgatagcactttcagtagtgtaaacaaaacacctaaaacacagagtctctgatgaattatctaattttatttctcaccgtttctactcccacttctatcatcaattccagccacataaaataatttttagctcctcaaatacatcatcatactcagcaatatcatatcatacaataaatcttttctgaaaactgccccaagtcccttccccacacctccatctaatttctagctatgtctctttagggctttctaactgtctccatcaaagcacttttcacattgaactatggaactatgatctccactaaaaggtaagccgctttatggcaggaaccataacctaacagtgtcagattcttaggatatgtttactatgagttggaaggaaaggagaggagaggggaggggaggggaggggaggggaggggaggggaggggagaggaagaatactctggagcacacaggtgggaatatctgggaggagcagaaaagacttcagaaaagagatgacatttgagctatgtcttagagtggcagagaaactaaagtgagaaggcagacatttctcttcatcacaatggccaataatcttttttgagacacaaaaatctctggcatgaattagtgtaacagttccctactaggtgtcactatatccaatatttactgtctcctagccattttccacagttcagcctagtggtctcactaaaatgaaaatctgagtatgtcctgactcttaatgtaggttgcaagattgtttataatctgactcctgcttgcctctccagatttaagggccacctccccccaccacacacacacatctgaaacactgttccaatcatatatgtacagttcctagcatgtgccaagcttgtccttttacctctgggcctatgtaccaagaacactgttccttttatttctgcctggatgatccctagtgctcctttaggactcagtttctacatcagttcctgtaggactcagttttttttatctttccttgtgaatgactaggtcaaatcacctatcacacattcttgcagaatcctacactgatcacaattataatgaaatgattgtgaaatacttgtcttccaaaaaagattacgagttccaagaaaacaggcagttggtctttttcttattgtctcctcaatgtctatcatggtgtctggcacaaagaaaatgttcaataaatatttgttggcttaatgaccaaactgaagtaaatgaatagacaaatgtttttatttccaattagattttaagcaaaatgagggcaagtttcatgtctgtcttgttcatcattgtattcccactgtctagcacagtgtctgacacataaaactctcactaaatagttgtaaaataatgaataaatgacagatcaaatgaacatggcatcctgccacattgcattactaaatgctctatgataaacacattttatctttctaaagttatattatggctgggaattaaattataaaacaatgattatcaaaaatcatagatataaacaataacatggctgtccctcagtatccatgggggattgattccaagacaccactgccccagtcccacgaataccaaaattcacaaatgtgcaagtccctatagaaaatggtgttgtatttacatataacctatgaacatgctcacgtatactttaaatcatctctagattatctataataactaatacaatgtaaatgccatgtaactagttgttatactatattgtttagggaataattatgagaaaaaagtctgtacatgttcaggacagacacaaccatctatttttttccaaatgttttccacccatggttgatgaatccatgaatgcagaacccacggacacagagagctgactttatatcacaaaaaagcttcaacagctgtaaacatttgtcatcatttaaagttataaaaattaggctctatatccaataaaacattcatgcatatatttttcacaatagttggagcttcaatgtaaaataaagcctctgtaggccacataaatttttactagctaaacgaagtatactaggtataaaaataatcaacaaaaatttagcaaggctttctagaatttagaagttcttttaaggaaaattaggatagccctcatcattaaacccggttggggtttgttaatattttccttaaatgaaagttgatattattcaatgcagtaaccaaatatctgaacatctcatttaaggtccttagatgagaggatttggaagactggaatcatcattattaatactgttgctatggatgcttttttcctaagctctttgactttatttgaagtagaccaagaatattagatcaaggggccagatggtaaatatcttaggctttgctggccatatgctgtctgtttctactactcaactctactgattcagcatgaaagcagtcatagacaatatataacagaattaatgtggctgtattccaataaaactttacttacacaaacaagcagcagcagtttgttctgcaggccagtttgcagattactcttaagtaaacaattgctgttttaactgcctagcattcattgacaattcatttgctaaaggcaccttgatttttatttgcgggatcatctctcctcctctccaaacccttgtagttgcagtggaattgacccgaggcctttagggccagaattagtcaggtggccgaagactgtccaattagaatgtctttacgttagcttcagtgactggttcaaggttgaacaaatgaaccacgatggtctactgtgtctcaatcctgggactttttggacaattgagaaacattttttatggtggggtcacaatgtaagtcttcagctgctagtagaaaccatgtagagaaaaactgcctgtgggtgatgccaacacagaagaaagcaaagcccagatatgaagagaaagagagagaccaaatccagaagggctcatctaagcaatacaacctagctgtgcctaaagacacatctcagcctacagccaaaagagatccaaattcaactgcatggataacatcaagaaaactcttaaagaagaaaagtaacccaattgagaagtctatgagatactgtggaaggtacagttatatatctctgagccagtgcagaagagtgagaggaataaggaaggatagatagccatggaatggatatgagtcagggattttttaaaccatgaaatgctgaaacagtctttctctcccacgttagtatctaaagagtctgtaattacagaacctacaaattgctccacaaacttgggggtaaaggtggaaggtggaaaggagagtcattagctaaatcatcctgaataagaagataatatacaaaatctcccaaagcagtatttccctgtaatctactaaaggcttaaaattaagggatagggtccccactcaaacagagcttgatgttttctactgcactaaccataatccatgaagaaaagaagctcagaactttaaagagggaagcatttcaggtcactttggtccaatattggaattatttgtttttgttaacttttattttaggttcaaggttacatgtgcagttttgttatatagataatttgtgtgtcacaggggtttggagtacaaattattttgtcatccaggtagtgaacttaatatccaattggtagtttttcagttctcctcctcctcctacactccatcctcaagtatgacccagtatctgttgttcccttctttgtgtccacgtgtcctcaatgtttagcagccacatataagtaagaatatgtggtaattggttttctgttcctgtgttagtttgcttaggagaatggcctccagctccatctatgttgctgcaaaagacatgatctcaccacattttctttatccagtctaccattgataggcatttatattggttccatgtctttgctattgtgagtagtgctgcagtgaacatacacacgcataggtctttatggtagaacaatttatattcctttggatatatacccaataatggaattactgcgtgaaatggtagctccattttaagttctgggagaaattgcccaactaccgtccacaatggttgaactaatttacattcccacaagcagtatacaagcattctctgttctctgtttgctgaagttgtttatcagttctaggagcttttgggtggagactatatggttttctagatatggaatcacacaccttcaaacagaaatagttttactttttctctttttatttggatgccttttatttatttctcttgcctgattccttggctaggacttccagtacgatattgaatacaagtggtgagactgggcatccttgtcttgtttcagttctcaagggttatgcttctagcttttgtgcattcagtatgatgttggttgtgggtttgtcatagatgtctgttattattttgaggtatattccttcaatcctacattgttgagggtttttaacatgaaaggaggttgaattttatcaaaagccttttctacatctattgagatgatcatgtggtttttgtttttagttctgtttatatggcaaatcatatttatttgcgtatgttgagccaaccttgtattccaggggtaacatctacttgatcatggtagattagctttttgatgtgctgctgaatttggttttctagtattttgttaaggatttttgcatctatgttcatcaaggatattggcctgaagatttgttttttgttgtatctctgccaggttttggtatcaggatgatgctggactcacagaatgagctggagagaagtctctcctcttgaatttttttgaatattttctgtaggaatggtagcagctcttccttatacagctgatagaatgtgacagtgaatccatctgatccagggcttttcctggttggtaggcttttggttactgattcaatttcagaactcatagaattgttcaggatttcagtttcttcctggttcaatcttgggaagttgcatgtttccaggaatttatccatttcttccaggtgttctcgattgtgtatgcagaggtgttgataatagttcctgagggttttgtgtatttctgtgggggtcagtagtaatgttccctttgtcttttctggttgtgtttatttggatcttctctctttttttctttagtattccggctagtgggtctatcaaacttatttattctttcaaataagaaactcctggattcagtgattttttttgggggggagcatggcttttcatgtctcaatttcattcagttcagctttgattttggttatttcttgtcttctgctaacattggaattagtttgcttttgtttttctagttcctctaggtgtgatgttaggttattaatttgaaatctttctaacgttttgatgtgggcatttagtgctataatctttcctcttaacactgctttagctatgtcccagagattctgatatgttttatttttgttctccttagtatcaaataatttcctgatttatgatttaatttcactgtttacccaaatgtcattgaggagcaggttgtttaatttccatgtaattgtacagttttgagtgatattcttagtattggtttctatttttattgtgctgtggtcagagagtatggttggtaagatttctgttttcttgaatttgttgagaattgttttctggccgattgtgtggttgcttttagaatatgcgccatgtgcagatcagaagaatgtatattacattgttttggagtggagagttctgtagatgtctattaagtccatttagtcaagtgtcaagtttaggtcccaaatatctttgttagttttctgtctcaatggtacaacactgtaagtgagatgttcaactctctcacctcacttttgtaggtgacctgtcccttttctctagctgcctttaacattttttcttttattcaaccttgaagaatctgatcaatgtgtgtcttggggatggttgtcttacatagtatctcacagggtttctctgcatttcctgaatttgaatgtcgacctctctagtgatgttggaaacattttcatgaatgatatcctcaaatatattttccaggtttcttgctttctctccctctctttcagagatgccaatgggtcatagatttggtctcccatatttcttgaaggttttgttcatttttttaattcttttttctttatttttgtttgaattagttaattcagagtaccagtatttgagctctgagagtctttcctcagtgtgatctatttgtgctattaatacttgaaattgtatcataaaacttctgtagtgagtttttcacctctatcagatgattgtgactccttcttaaaatggccatttcctctctttcagctcctgtattattttattgtatttcttagattccttggactaggttttgactttctcctgaatcttgatgatttttgctcctattcatattctgaattctatgtctgtcatttcagccatttcagcctggttaacaaccattgctagagaactagtgtggtcattctgaatacaaagacaatctggcttttcaagttgccagagttcttgcactgattttcttatctaggcaggctgatgttcccttaatctttgaagaagccgtcttttagatgaggttttttgcttttatctctctgatgcccttgaaggtttgtagtataaggtgggttcagtcaacaggctttgtttctggaagactttagggggccaaggctcagctcagcactgctgggctgtgtgctctaactcttatgggcgtttaccatgcccccagctttgttctctgaccccttgcagttaagaacctgctgtggtggaggggccgaggtattcttagactgctagccacaacgctacaatggagagtgtaagcccaagtgcttcatcagagcaatggcagagatctgtgctcactcattcatgccagcagtgcagtggggatgcacacacatgatggggtcagtgggagtggagtggcggtattcgtatgcatgctcacattggtgaccgtagcggtggggcaggggcaaggcattggcagagatggggttgtcagagtccatgtgcacatccacgccagcagcagtgcagcaggatgcccaagcatcaggaggagcaggatagcatagtgtgctcacactggcagcagtggggcagcggggtacacacacgcatgccagcatgggatgggaggcaaggtctactcacacatgcaccagtaaagcaatgtgtgtgtgtcaaggggggaggggaggtagtggtccatgcctgagtaagtgccagcaaagcagcagtggggaggctgtagtgggtgaggttgtaggtgggttggtgtgtgtcaacaagagctggtctgctggagctctccagtagtcatgcacagactgccagtgaaggagctatgatgagatccctgaggaagcaccttggttgggcttgccaggctgcactgcaagtgtgtggccaggctggagccccaggagaggccaccagacagaggggcactcagattggactggacccatcacatgggaaagaccaccctgctctatccaggtctaacagttgcccaaaagctaaagcctcctggaggagcatggcaagccttggtgtatgggtatccctggccatgctccacttcagccattcccatgccaaaccttctgctcctacaacctatctaggcagctctccctgccagctcaagtgtctgtggggattgtggggtgtcctgctgctaggattctcaaagtccatggcaagagctggtcactccttccctgttcaactcaccccttccttaggagttgctggggaccagtaatgaatcttggtgctccgaaaccctgcgcaccgttcccagcttcctcccgcttcagcccagcaactgaatcctctctccatccactctcaatgccttctctctgaagatctgcttagagtgtaccagtcttcccaatgttcttgtttctcagtgaaagatgttcctcctagttgcatctagttggccattttggctcagatcagaaattgccattttaaaaatcagatcttcattgagacttctatcaagtcaggctcaaaggcttagatttttaaatcagtgttgattttgcacaatattttagaagcttctttctgcacattaaatcaatgtttatgtcaaatacttgttctagacctccccacatctctcaatcagtgatgaccattagttttcacataaattcaagtatttatgtacttgacaaattaacaaataatttgttaagatgatcacatagaattaatattactcgttccagttgcatggtggggaaaagaaagcagaatcaatattttctgaaaacctattttgttgcaggcattatattaacttgatgatttatagctatatccttgtataaccctcacataattcaatgaggtaggttttattttccctgttctcagaaaaagaaacaggttcagcaaaattaggtaacctgtacaaataacatagttaataacaaaagtcagatatttctgcaatactctagtgcctaacatccctggaaacaaagagaaaaatctctgtggatggtgaagataagtattgctgcttaagttttgatataaaaatcatatagaggatgcttacatgcaacagataatatccaaaaaatgcataagaaaaaaatttcctcctgagaggatttaaatctaatctttgaattaaaagtaagacctaaaataattgtagaagacaacatacaatgaggcctcggtcaagtgtttcagtacttcagaaaatgaagaattttacgtgatatagaaatatttacttgaagcaaacattttataaaacagtatgaagcattcagtaatacagctgaggtacacctggggtactaatttggttatttctaggctagaaagtggtttcatgtttaattcactgctttctgaagaggaattgatctctaattgactgtaaagttatggtgagttctagttgcttattttctttgttcctgtaatattaatttcttataatctccaagcaaaatataacattatctaatgttcacttgagtgtctgaataccacacgttacctcaatagatatgttgttttttttcacatagcccaacacatttttcttcaaagtacaatacagttttctatgattttttttaagaaaaaaaaaatccaaattcagttgcagatcctctaaaaccttatccgtatccatttctttctcttgttccctagctgtgatctttaaaataaagttgatatgcaggcataccttggagattgtgattttgatccatatcaatgaagctaatatcacaataaaataagtcacacaacttttttcatttcacccgggcatataaacattatacttacactatactatattctacttagtgtgcaatagcattatatctataaaagcaatgtacataccttaatttaaaaacattctattgctaacatgctaacaatcatctgagccttcaattagttataatctttttgctggtggagggtcttgcctcagtattgatggctgctgactattctgggtggtggttgctgaagattggggttgcaatggcaatttctttcttttttcttttttttttttttttttttttttgagacggagtctcacactctccttcaggctgtagtacagtggtgccatctcaactcactgcaagctccgcctcctgggttcacgccattctcctgcctcagcctcctgagtagctgggactacaggcgcctgccaccatgcccagctaattttttgtatttttagtagagacgggttttcaccgtgttagccaggatggtctcaatctcctgaccttgtgatccacccgcctcggcctcccaaagtgctaggattacaggtgtaagccagtgcgcccggccggcaatttcttaaaataagacaacaatgaactttgccacattaattgaatctttctttcatgaacaattcttctatagcatgtgatgctgtttgacagcattttacccagagcagaacttctttcaaaatcggagtcaatcctctcaaaccctgccactactttatcaactaagtttctgtaatattttaaatcctttgttgtcatttcaacaacattcacaggattgctgagggattgttcacaggattgatgaggcctcattgtatgttgtcttttcttctacaattattttagttcttacttttaattcaaagattagatttaaatcctctcgggaggaaatttttttcttatgcattttttggatattatctgttgcatgtaagcatcctctatatgatttttatatcaaaacttaagcagcaacgttcctcaggagttgattttgtctcaagaaaccacttttttttttgctcatccacgagaaacaattcctcatctgttcaagttttatcatgatattgcagccaatcagtcccatctacaggctccatttctaattcactcactatttctaccacatcttcagttccttcttccactgaagtcttgaacctctcaatgtcatccatgagggttggaattaacttggtctaaactcctgttaatgttaatgttgatatgttgacctcctcccatgaatcacaaatgttcttaatagcaagtagaatggtaaatcctttctagaaggttttcaatttacctttcccagatccatcaaaggaatcattatctatggcagctatagtcttacattatatatttcataaaaaagacttaacagtctaagttaatccttgatccacgggcttgcagaatagatgctgtgttcgcacacataaaaacaacactaatatccttgtacatttccatcagcaatcttgggtgactaagtgcattgtcaatgagtagtaataccttgaaataaatcttttgagcagtagttcttaacagtgagcttaaaatactcagtaaactatgccataaactgatgtgctttcatccacccaggcttgattgttccatttttagagtacaagcaaaatcaattttgcatagttcttaagggccctatgattttcagaatggtctatgagcattggcttcaacttagaatcaccagctgcattcacccctgacaaaagagtcagcctgtcctttgtagatttgaagccaggcattaacttcacacctctctagctatgaaagtcctacatggcatctttttccaatacaagactgtttaatctacattgaaaatctgttgttaatgtggccacgttactaatctgctctcatgctgctacaaagaactgcctgaggctgagtaatttataaaggaaagaggtttaattgacttacagttccacatggctggagagacctcaggaaacttacaatcatggtggaaggggaagcaaatatgtccttcttcacatggtggcaggagagtgaagtgctgagcaaagtgggaaaagcctcttataaaaccatcagatcttgtgaaaactcactcactatcatgagaagagtagcatggaggtaactgctctcatgattcaattacttcccatgaggtccctccctcaatacgtgggtattacaatttggattacaattcaagatgagatttgggtggggacacagagccagaccatatcagccacctttatcaattaccttagctagatcttctcaataactttctgcagcttctccatcaatacttgctgcttctccttacagttttgtactatggagacagtttttttcttttaacctcatgaaccaacctgctagtttcaaacttttcttccgaagcttcttcacctttctcagccttcataaaattgaagagagttaagccttgttctttattagcttttggcttaagagaatattgtggctgatttggtcttctaaccaggagaccaaaactttattcacatcagcagtaaggttttttgccttgcttatcttttgtgtgttcactgtaatagcacttttaattttcttcaagaacttttcctttgcgtttacaatttggataactgtttggcataagatgcctagctttggcctattttggctttcaatatgccttcctcactaagctgaattatttctagctttgattttaaagtgggagatgtggaactcttcctctcacttgaacacttaagagcccattgcagggctattaattggcttaatttctatattgttgtgtctcagggagtagggaggcctgaggagaggaagagaaataggggaatagctagtcggtggagcagtcagaaaacacacaacacttactaagttaactatcctataatgggcacagttgtgtcaccccaaaacaattacaatagtagtatctaagctcattgatcacagataaccataacagatataataaaatgaaaaagtttgaaataggatgaaaattaacaaaatggaacacagagcaaatgctgttggaaatatgtcaccaatagatttaatcaatgcagcattgccacaaaccttcaatttgtaaaaagactgtcattacctatgaagtgcaataaggtaaataaagtgcaataaaatgaggtatgcctggatatctttcccacccactttaaaacatttttactgtgtattttctcatagacaatatattgtactattgcatgcactttaaaattacattaatagccaaataatgtacttaccctctgccacttttgtcagtcaagatcatgtttgcaagatttctagatatagttaatgatatgttttctacattttatagttttctagatatggatatttcatcacttattcactcggttctctagagatgaaaatttggattgtacttgttttgttttggtcttgcaccattacaaacaggattgcaatcaaaacttctatgtacattgaatgaaaacttctctagagttcatacctacatgtgaaattgttgagctcacagaaatttgccaaaaggttcatacaaaaatatttactacagcactgtttacaaagctaaaaactggatacactgaaattataccaaccaatagcagaacaggtatataatttttaatatatttatgcaatgcaattaaagagaattgtatagacgcatacgtgctgatacagaaagacgcccaaaattgattgctcagtgaaaaaaaaattaagttataatactctatataaaattatcccattttttataaaaataaatgataaaattaataatatatgtacatatttagagaaaaaatagagaccaatttaagaaattcatgttaataactatgtatgatatataagataaacttgtattttctctattttaaatttcaatagtaccagatacacattacttcaatctacacttataacctgaatgaatacataatttcttcttatcctaataatgacacattttgcttttctgaccactaacatcccttacaagactaactttttccattaattcctaaccaatttctgtttttagcacaaacaataatagtctgtacttacttacactactgcaatctccttgttgctatatcttgaaatttttcaaacttgaaattaattacattcattaccactgcttttaccaggaacccttctgactctataatattctctctcagacctgaataaatatcatattattataacaaccttctaggtcaattatgggatttcaagttaaaaatatataactgtaaaatttaaagaaggtgtgcagtgagaaggaagagttgttcattctggaaaaatatatttggatacccaatcaagtttccttagaatgtcatttacttgaaaaaattaaccattatccataaatgatactcttattcttaaagaattacaaaaattaatccctgtattatttctaaattgatcagaattatgggttctaattcagtctaataaaggtcacaaataattataaatatttagtaagctgttattcattgggcactatgtgcaagaaatagaggacatagtggtaaataatatagatgagctccaagtctaaaatggcatcaactaaattaggtggggatgaggctcttcattgcaatccattaagtgcagctcctggggcacaaatccttccatatatggacccatgaaatgaaagagacaagccatccttcttcaaaccccccaacctataatggtaggataggcacagcacaacagctatagacatcacagttctaatgggggaaaatgaaaagtaaaaaggagtcacaggggtcactgtttcaaaggagttctgaaatccagggagtaaatgggagtttcttgattaggtttcaagggcagagaataatcctccttggctctcagctccattctctgaaggctccatccttcttggttctgccctctgagtcatccttcctttttcatgaaaggtaacacatgtttgtagcttagtggttttatcagactgcttcctgctggtagaattttggggacttaaccatctcctttccttttgtagtattgtctctgacctttttagatgaagctggcagtgtttctgcttcaataaatttctcaagaactttgtgggtcttccatggatttcacagggattcacaccataaaagaaaagccacatccacagatgtttttaagattgtcccttttctatatcttggcttcctgctgagagggctagaggacaatgcccttcagcctcctagaggccctcaggtttgtgtgaaaaaatcagtgaggcacacccttaatctcttgaaaagagcctttgtactgaatacgctgacattttgatctttctgatatttttagcaaaagtcacacactctcaatgccatacttttgagtatggctatttctcaatgccatacttttggcagccatttctgaattttagcatcttttgccatctggagaggctgcgaattttcagtcacgtaatcctaatccattttctttaacatgtcttccttcaacttatctctcttttgcattctattacaagcagtaagagaaaaccagtagcaacttcaatactttgcttgaaatctccttagcactacatacaagcaagttcattgcccacaagttcttctttccataagatggcagaatgcacaattttgctaatagttctgcaagtatataaaaaggatccctctccttctaatttccaataacatgctcctcacttctgagcctaacagcagtgctctcaaagttcagatttctactaagggtctgttcatggcaactcaggctgctatggtttgaatgtgtcccctaaatttcatgtgttagaaacttaatccttaaattcatgtgttgattagaggtggggtcttgggggctaattagggttagataatgtcatcagggtacagtccccatgatggaactaacggctttataagaagaggaagagagagagctctgagctgacatgcacactcttgctctcttgccttgtgatgccttctgtcatggaatgagcctcactagatgacggcaccatgctcttggacttcccagcctccataaccatgaactaaataaacatctattgcttataattttctctgtctgtggtattctgttacagcaacagaaaatggactaagacataggcttcctctatcatgttctgcaaacatttcctagcctttgtctactgtctaatcccaaagctgctcccatattttaggtatgcctcttggtaccaaaatatgcataacatcttggtggcttaaaacaacactcagtcagtttctcctgcttttcatcagtcaggagtctgggcctggctcagtcttatgctcaaagcctccaaagctgcactgaaggtattggctggactatggttctatgattctgatctagagcttggggttctctctcaggtttactcaggtcattggaagaattcagttccttgcagctgtaggactcaggccgtcagtttatataagctgcctctctccataggcagtttacaaaatgattctttgctttcttctagcccagcaggagaccatctctctttaaagggcttacctaattaggtcaagcccatccagtaaaatctaccctcaataaccttaaatccaactgactgggggccttagttacatgcaaaaagccttttatatgcttatatccctctgagtcaggaaaaaactaccagagttctcactcccccatcaagagccccccgacacacacacatacaaacacatacctaattatagataatatttttttctaaaatacatccatatggttgtgtgattttctccagtggtgctgaacaaccttggttcagaagtaaagaatcttgacactagaactaatccaagaaaagtgggtaagaaaaggtccctaaaaggttctcaacatgaagcagcaggagaaattcagaagaggaagagagatctccatcagccacttggagtagataaaggtatcaggaccaagatatgctaaagggggcagataatcatcctgtcacagaacagaaatctcaattagaaggctttcctaaaaaaatttcaaaagaccataactgctcttaccacactttacgtaaccaagaagtggtaatcagataaatctcctaggaaagagcttatcaactcaattgagactacatttatatggagagggacagaggcagccaggcacatgagtcagctcccctgcccccagcaccaccttccactgtgaggttttcagacttgacaacaaggacaatttattatttcacattgaccaaaatccagtggttaaatgagattacagtcctgttgtattagtttcttattgctgctgtaacaaattttcataatttattggcttcaaacactcacaatattttactattctctaagtcagaactatgaaaatcaaggtggactaaaagtgtcagcagggatgcattccttctaggggctctaggagaatctgttttcttgccttttccagcttctagaggagacttgcattccttgggctcatggcctcttcctctaccttcaaaagccagcagcatatcattttcaaatctctctcctactctgagatttccaccttcatcttattaggacacttgtgattatactcagcctaccttgattacccaagataatctttccatcttaaaatccttggcttactcacacctgcaaaatctcttttttacagaaggtaacattttacaaactttcaggcattaagatgtgggcatctttcaggggtctcattttggttatcacaacttccaaatacctttctaatattcaaactcaatcatttcatttgggctgatgataaaaatgctctgtaatgttttaatgagtttgcttataaagtttatctgaaatatatttctataaattcttatattctctgacaaaatcaacagaggtgttagattgaacaaatttgattagctaatagaaattgttaagtaacatcatgttcttaaggagttgcttcaaagcattcacaaagcacctaatttatccttgcaattgtcaaataagtaaaagtaggtatcataaaagaaaatttcaagtaaggaaatgaaagcacacagtggctttcctagatctcccagggagaaattctggaagaaatatgaatagaactcagcttctcttactcccattcagtagcttaaaaggctaggaataatagttacaatgattcatactgattacctagtgcctcttctccaaagtactgcaaatccacaagagaaatcatcacagacacggtgatatgtctttggttagtttttctacctcctggtttcaacaaagctttaaagaagtatagagaacatggaacaatctgtgagaaactactccacctcgagtggttccacttgaaatgtaaataggtttggaaggtcttaagtaaacatgacttgaaatttaaaaaacatatattgttaacctgactggaaggtaaaaacaaatttagaagaataatggatgtgctgtctggaggctataattactggtgctctaacacagcagtgtagcgagaggctgggaactgcttcatgaaaagtgctggggaactggacagaaattggttggaatctcaattcttctgcttatactagctgtataaccttggacaagctacctaaactctcagattcctcatcttaaaaataataatagctgtcttatagagttgatataaaaattaaaggtactacatgtaaaatacccggcacataaaagcacttaatatctttcctacttgggaaaaaactaaaatgtaggaacagactttcctgttaagaatgtttgtagtggatgctctgttgtgctgcccagattctgcttcagagaggaagagtttattctccaagcggctggaagagctgctaatggaaagctctttgttgtcagcccctacagggatcgccttagttgaagagagccttttcacccaatgtccaccccattaagaatgacttgcctccagtgactgatcaaagagcccatcatcccagatcagaacttgccatggaattggcagaggcctctgttgagccagcctgccagttcagcttctccctcggtccaatcctgcttccttcctatgacttcccttctagaggtgttgatctcaatgccctccctaataagccctccgatatcctagtcacggttgggagtcagtttaccagggaacactatccagcaacaatgttgcaggatgaactgttgctcagacttttatatagcccttaccatcaccaaccactccccacaagggcccaaaggcacataactcacccaagtatcttttggttgctctggtaaggattgaagagtaaggattcttaagccttgaaccttgcttctgctgatgtttaacaagcagctggaataagtgtgaaccctctgccccagctccatttcaccccttctcaacatctttcatctgccagcttgtataaagattcagcctgccacattagaaatgttgcttatgtcacaattgaggaaattttaatatgagctgtatagcaaatgatattaataattattaatattgttgttcttgagctttataatactccagataaaaaaaaaaaatgaaggcggataggccgggcacagtggctcacgcctgtaatcccagcactttgggaggccgaggcaggcagatcacgaggtcaggagatcaagaccatcctggttaacacggtgaaaccccgtctctactaaaaatacaaaaaattagctgggcatggtggcgggtgcctgtagtcccagctactcaggaggctgaggcaggaaaatggcgtgaacccaggaggcggggtttgcagtgagctaagattggccactgcactccagcctgagcgacggagcgagacttcgtctcaaaaaaaaaaaaaaaggcagataaatgaaacaagattggcaaaatgatgaacattgatgaagctgggtgactggtattatactattctccctatctctgtatgtttgaacttttccataataaaataatgaatattaatatactttataaaagtatatacaatgtacgtactttagagatcaattgttaaagataggtttaataatatatttaacttcaagttggcttatgttaagcaaataaatcaaaatatagaaaattcatattctccaaagcaaataaaatggggcttgttaggcatcttgccaaatagttccgaaatttattttttttaagtgctgagactttctttaaaagaaaactccataaggcacttcaaactaaatttttatgttaaaagatttattttacatattaaagtacagcatacaggtattttgttcattatacagacttttagattatgaagactttatatgtaatagcatattatcccaatttttaaaagctcaattttctagatgtcttttttgataacaatgcatgtgatttaccataacatgtgtataaaatctagccaaaccacaccattcttcctccacaacccttaaagaagatcctatagactcaacaactgtgccacctaaggctatgtaaactttggtcaaacaactctgttgtatacacaaatatagctatatctacaggtatagatagagagatataatatatattatttatacataatgattaagaattaagaattaggtcaaaaatcacaacaagaaaaaaaaaagtagtatctgattcaggtattcagtctgtgtagagtggtactatttttgccaatcctcaaatgtttacttcaagtctgctatgatgagaaaacccagaaggcctaaatatataacacaaacatgtttcccatctttgtatccttctatgtttgaagatctttccgaatgttaaggtctcatccatttaaggtgatttgatccagaacattggggaatactattattcagaaaatgattcttcttaaagggacttgattatttcaatgatcatagagctgctctaagggatttctatagccaagtcattattatatccaggtacttttcatataaataagggttcaagcatctgaaacaaaaaagaaggaaatgaagtgttctaaggacaaagacaaatggtgtgagttaggagctggtctaacagcatataaagcctgaattttccaaagtattttacctgactctctggactaccccccaaataaacaaacaaacaaaccaataaaatccaaatatgtataaaacatatgcatgttgagcctagtcctataggaaacatgacaggtttgagaagaatttgatgcaaaataaaatgggatgagatgtgataacgatcaggaaaattaggatctagtactagatgtgcactaactaagctctatgaccctgggcacttcacatcttggctctcagtttgtctctctgtaagatggaggtcccttacagctattatattccaagattaagaatcaagtatgatactttcaatattaataagtaaccataaaaattttaagcaattggattaataccatcttgaattgaaataaaacaataaaaaatttaaaatttttttctaaaagttgaaaataaatgttttttattatatgagtttaggtttccaaatatgtttttctcccatactacattttcctatagctttgtgaaataatatgagattaatcttatgccaggcagtccagtgggtgctctgcaaacttggctctagaggaacttgataattcagatataagccatgcaattttatatttcaaatcaaaactatctaatgtataattaagttaaaattcaacagttacagtctagaatagccatcaattcagttttaaacacagtgtataaaattttaagtcctgcattttaggtacttgtgggctattcagcagggaaactactttaggctagtgagataaatataaaatttcatgttgtaatataattttgaggcagcattaaatgggtaaaattcaggtagtaagcctaaaaatccaagataactatagagataaataattatttttgtaaattataataattcccatatctgtgataataatagcaactacagatttgtataaggctttaatttatacaaataaatctgtttcaattattacaaatgtaatacaagatacatataatatgtatcgtgtttacattcttacggtatattttgaatgtgttacatcatttaagtaataacataatttaggcattattatctttattcattattatcatctccattttatggatatggaaattgatcaaataaaactttaaagagcaaacaggctgcctgaactggatggagagatcatggtgctaaccacatcaaggttagttgttaagtttctcatcctagtggagtctcagtcagataatcataatagaaatggaaaatgtatttaggccacaaacagattttcagcatctattgatttactaatatagctttttgttccttaatttattgatgcagtgaattactttgattgagttgctgctgtttaaccacctttctattcctggagtagattctactaggttatagatattatccacttattaaattgctgtactctcttataaaaatatctagacatacattgacatatgagatgattgatttttttaaaaaattggtattatcttaattggatttagggatcagcattatattagcttcaaaaaatgaatgttttatctttttctattgccaggaataatttagaatttatagtgatactcacacaccatgatcactttcttttctctctttattgtatgtatctgaaaaatcctaaccatggctaaatctaattccctgcctattcagagcagcttaacatggttgggggaaaattaagtttcctactctttatgatgactatttcagaccttctttcttctccagcacacaatgccccacatcactctcaatcaataatcattattatttcactgaaaaaataaaatagaaaaaaaatcctcactcttccagcagtaaatcagaaaatctacttgtatcaggatgtatatactctcatttcactccttggcaataaatgaactgtccatgttcctctagtgaagtcaatacgtccacctattcactgggtctaaactttgccttatcaggacttcgctactcaaaaaaaaaattttttttaatttctcttttttatcatttttttcacttgctacttgtaagagatattccagtctgcctttcagatttctcctcaagatagtcactaatttcccccaaatgccagaagtgttgcctacagaggtttacaggaattgccttgaccaacatgacaccacacatccagtgttttgtcagtgggtttattcaattccatggcctcagttgagttttctcttaagggtcatctcagtttcagaggtacataaagaatccaatgaaatctctgttacagttacatcacagttcaacttcttttgttccaccttattcctttcactcctttactgtattgttcccgagagcacttcccaataaatcacctacacgtaaatcttagttgtagagtcttttttttctgggaaacctaagctacaaaagttgttgccagggaattggataaaatcttcaatagtaagacattcagtagagaggataaattagtcctacacaacaggctgctatggaatcatcttagcaaagctaaaaagccattgttatacagataccaaaatcagacagactttaatgaaaacaacaggccaatatctttcatgaatatatacacaaaaatcctaaacaaatattagcaaataaagctcagcaatatgaaaggaggataatgcattatgaccaagtgaggtttatccctgggaatgcaaggttgagttaacatttgaaatcaatcaatgaagttcctcgtattaaaaaaaaaagaaaccctataatcatcttcatagatgtggaaaaggcatttgacaaaatttaatatatattcatgatgaaaaactctcagcatctgaggaaaagggaaactttctcaacctgataaagggcatctatggaaaccttacaattaacaggacaatgatgaaaagctgaatgttttcctcctaagattgagaaaaagcaagaatgcctactttcaaaattccatttaccatcgtgccagaggttctagccagtacagtgaggcaaactaaacagataagaagtatacacatcagaaagaaagcaataaaattatctttattgacagacattattatcacctacatacgaaatactacagaactttaaaagctactaaaactaataagtgattataccaaatttgcaacatacaaggtcaatatatatcagtaaaccattggacagatcctccaaagtcttaaaggcagccagagagaagaggcatgtcaaatgcaagggaactccatcaggctaacagtggtcattttagcagaaaccttacaagtcagagaggttggggacctatagtcagcatccttaaagaaaagcaattccaaccaagaatttcgtatccatacaaactaaacttcatacgtgaaggagaaatatgatcctttccagacaagcaaatgataagggaattcttaccaccacgcctgccttacaaaatgtccttaagggagtgctaaacatggacatgaaaaagcagtactgtattagtctgttttcacactgctaataaagacatacccaagactgggtaatttataaaggaaagaggtttaattgactcatggatccacatggctggggaggcctcacaattatggtggaagaacaagggatgtcttatatggcagcaggcaagagaaaataagagccaagtgaaaggggaaaccccttatcaaatcatcagatctcgtgagacttattcactaccacgagaacagtatggggaaaaacacccccatgattcagttatctcccactgggtccctcccacaacacatgggaattatgggagctacagttcaagatgagatttgggtggggacacccaaaccatatcaagtactttccaccaaaaaaatacactcaagtacaaggccactgaaactataaagcaactatataataaagtctacataacaaccaggtaaaaacacaatgacaggatcaaacacacacacatcaatactaaccttgaatgcaaacaggctaaatgccccaattcaaaggcacacagtgacaagttgggtaaataagtaagacccagctatgtgttgttaagagacccatctcacatgcaatgacaccgataggctcaaaataaagggacggagaaatatctatcaagcaaacagaaaacacaaaagggcagaggttgctattcttatttgagacaaaacagattttaaaccaacaatgatcaaaagggacaaagaatggcattacataatgagaaagggttcaattcaacaagaatacttaactgtcctagatatataggcacccaacaccagagaacccagacttataaaacaaattattacagacctacaatgatacttagataaccacacaataatagtggaagacttcaacaccccactagatcattgagacaaaaaattaacaagatattcaggacctcaactcaacacttgaccaaatggacctaacagacatctctagaatacttcacccaacaacacaagaatatacattcttctcatctacacagcacatactctaagatcaaacacacacttggctgtaaagcaattctcagcaaattcaaagaaaccaaaatcataccaatcacactcttggaccacagcacagtaaaaatagaaatcaataacaagaagatctctcaagaccacacaattacatggaaattaaacaagctgcttctgaatgacttttgagtaaaagacaaaattaaggcagaaatttaaaaattctttgaaactaatgaaaacaaagatacagcatgccagaatctctgagacacagctaaagtagttttaagaggacaggtttttctttttttcaagttttattttagatttagtggatacatgtgtgtgcttgttacctaggtatattgggtgatgctgaggtttggagtataaatgatcccaccatccaggtactgagcatagtacccaatacttagtttttcaactctcactcccctcactatctcttccatctagtagaccctagtgtctactgttgacataagatgaaagtttatagcactagaaacctacattaagaagttaaaaatgtctcaaattaacaaccaaacattgcacctagaggaactaaaaaaataaaagtaatacatgcaggaattttgtagaggggagtttaaaaaagcagcagaaaataattaccctgaatctcaagacctagaaatactgatattgttttgatatatttccatccagtctttctctgagttttttttacccagttaagattatactgtgtacatgcaattttctgtcctgctatttcacttaacaaatgtcttaaacatttctccttgtcattaaaaactctctgttcacatcaaataaataaataaataaataaataaataaataaataaataaaagcaaaccaaccccgatgctagcagaagaaaaaaaataaacaacatgacagctgaactaaacaaaactgagatgtaaaaatccatactaaagatcaacaagaccaaaactttgttgaaaaaataaataagatcaatagactgctggatagattaattaaaaaagagagagaagatccaaataaaaacaatcagaaatgacaaaagggatattaccaccagccccacataaatacaaaaaaaccctcagagacaattataaacacttctatgcacagaaactagaagaaatgtataaattcctggaaacatacaacctcccaagactgaaccaggaggaaactgaaacactgaacacatctataaggagttccaaaactgaatctgtaataataaaaataataaaccctaccaacagaaaaagccctggaccagatggatccaccgctgaattctactgcatgtataaaaagctggaaaccattactattaaaattattcaaaaagaattaaggaggagggactccttcctatctcatcctataaggccagcaccattttgaaaccaaaacctgacagagacgcaagagaaaactacaggccaatatctctgatgaacatagatgtaaaagtcccaaactaaatattagcaaaccaaatccagctgtgatcaaaaagttaattcaccccaatcaagtaggcttcattcctgggatgcaaggttagttcaatatgcacaaatcaataaatgtgattcaccacaaacagaagtaaaaataaaaccatatgattttgtcaatagacatggaaaaagtctttgataaaatccaacatcccttcatgataaaaaccctcaacaaattagatatcaaatgaacatacctcaaaacaacaagagtcatctatgacaaacccacagccaacatcatgtcaaatgggcaaaagctggaagcattccccatgagaaatgactgcacacccactaaccactcctatttataacagcactaaaggtcctagccagagcaatcaggcaagagaaagaaataaaagacatccaaataaaaggagaggaagtcaaactatttgtctttgcagattatgattctacacttagaaaaccccacagtctctgcccaaaagctcctagaataaacaacttcagcaaagtttcagaatacaaaatttattacaaaaatgaatagcatttctatacaccaataatccaagctgagagacaaatcaagaatgcaatcccaatcacaacagccacaaaaagaataaaatgcctaggaatacaggtaaccagggaggtgaaagatcactacaattagaattacaaacactgctgaaagaaatgagagacaacataaacatatggaaaaacattccatgctcatggataggaagaatcaatatcattaaaatggccatgctgcccatagcaatttacagattcagtgatattcctgtgaaactaccaacatcatttttcacaaaattagaaaaaaatgattctaagatttatctggaaccaaaaatgaagtcaaatagccaaaacaatcctaaacaaaaagaacaatgccagtgacatacattacctgactttaaactatactacaagtctagagtaaccaaaacagcatggtactggttcaaaaacatatacacagaccaacggaacagattaaaaaacccagaaataaagctgcacacctaaaaccaactgatcttcaaaaaagttgacaataacaagcaatggggaaaggacaccctattctataaattgtgctggaatagctgactacccatatgcagaagattgaaactggatcccttcctttcactatatacaaaagtcaactcgagttggattaaacacttaaatataagacttaaaatgtttaaaactttagaagaaaacctgggacgtatcattttggacataggtctgggcaaagacttcacgatgaagtctccaaaagcaatggaaacaaaaacaatcaaagataagtgggatctaattaaactaaagagcttctacacagccaaagacactattcaacagagtacacagacaatctacagaatgggagaaaatatttgcaaactatgcatccatcaaaggcctaatagctagaatctataagaaacataacaaaatcaacaacaaaaacaaataaccccattaaaaagtgggtaaaggacatgaacagacacttccaaaaaggagacatacatgtagccaacaatcacatgaaagaatgcttagcaacactaatcatcagagaaatgcaaatcaaaaccacactgaaatacaacctcatatcagtcagaatgactattattaaaaaggcaaaaaatgacagatgcttgcaaagttacagagaaaagggaatgctcatactttattggttggcatgtaaattagtccacccatagcagaaagcagtctggaaatttctcaaagaatttaagtcagaactaccattcaatccagcaatcctattactggatatatactgaaaggaaaataaatcgttccaccaaaaaaaaatgtacactcatatgttcattgcagcactattcacaacagcaaagacatgaaatcaacctaaatgcccatcaatggaggactggataaagaaaatgtggtatacacaccattgaatactatgcagccataaaaaggaatgaaattatgtcctttgcatcaacatggatgcagctagaaaccattattctaagcaaattaacataggaacagaaaaccaaataccacatattgtcacttataagtgacagctaaacactgagtacacatagacacaaagcagggaacaaacactggggcctacttgagggtagagggttggaggactgtgagggttgaaaaattacctaccaggtactatgctcactacctgggtgacaaaatcatttgtacaccaaacaccagcaacacacaatttacccatgtaacaaacctgcacatgcacccctgaacctaaaagttgaaagagaaaaaaaattaaaaattaaaattaataaaatcatttataatatgttcaaaaatatgacctattagggataaatataatgacagaacattgctcaaagaaatttgaaactggagaacattatgttatgtgaaataagccaggcatagaaagacaaatattgcatgtatttactcatatgttggagctaataaaaatgatctcataggggtagaatggtggctaccagaggttgggaagggtagcgaagcgggggatggtgaagagaaattggttaatgggtaaaaaaatatggttagacctaaggaataagttctattgttcaatagcacagtaggatcactatagttaatgataatttattgtatatttcaaaatagctagaagatttaaaatgttcccaatacatagaaatgatcaatatttgaggtaatgaatatcccagttaactggatttgataattacctggtgtttgcatgtaccaatgtgccacatgtaccccacaaatatgtacaatcattatgtgccaatttaaataaaaatcaagtcctaaattaaggtagctatgcatgatgttcatggatagaaaattcattatttataagatgccaattctttccaaattgacctatatattcagtgcaatcacagtaaataccccaggatttctataatttctatatattatagaaattgatgggctgattctaagataaataaggaaacgcaaagtacctagaacaaccagaacaatttgacaaagaacaatattgggaaattaacactatttgatttcaagacttaatacaaaagtagagtgatcaaaactgcatgggttttgacataagaataggcacagagatcagtggaataaaataagagtgtccagaaataaactcaccagatgtgaccatttgattttctacagtgacaccaaggtaattaaataggaaaataatgaaattttcaacaaatggcacagaaacatttggatatccaaatacaaaggaaatgaacctcaaaccttacaccatatataaaaaagtaacttaaaatgtaaaatagacttaaatgtaggccctaaactaaaatttctaaagaaaaatatagggtaaaatctttgtaactttggcttgggtacagatgtctctgaatacttaaagcacaaatcataaaataaaagactgataatttgaaaatcaccaaaataaaacatcatttcttcaaaacacactgttaagaaaatgaaaagtcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtcaacccgggaagcggagcttgcagtgagccgagattgcgccactgcagtccgcagtccagcctgggcgacagagcgagactccgtctcaaaaaaaaaaaaaaaaaagaaaaaagaaaatgaaaagtcaagccataaacttggattaaacatacatctgataaaacacttgtatcaaaacacataaagaattcttacaactcaataataagactaactggtttttgtttaatcattgaaagatataaagatactttataaaagaatatatatgaatggcaaataataagcacaaaaaagatgcttaacatcattgatcattagggaaatgcaaataacataccagaacatactctttagaatggccaataataagaatatgaacaataccaagtgatggaaattattgaatcaaccagaactctcagacattcctgatgggaatgcaaaatggcttagccattttggaaaacaattcagcagtttcttttaaacatatatttaccataagactatgtaatcccacatctaggtattttttaaaaaaaaaagacagagatgaaaacatttgtccacacaaagacttgtacttgaatgttcaaagcaacttttttcataatagccaaaaaacaatcaaatgttcatcgactgatcaatctaaaaacaaactgttcaatatccataaaaaataatgctactcagcaatgaaagggacagacaactaatatgtggatgaacctgaaaacattatgctatgtgaatgaattcaggacacaaaagaatgcatagtatctggttctattagtatgtaaatgaagacaacgcaatactatgtgatctgtgaaagcaaacagatcaaagattgcttaagtcaagataatgaggggattgattgcaaaggtaaataagggaatgtttttaagatgacaggaatgctctaaatcttaaggcaaatctttgacagttatcaaacctcatcaaattgtataactacaattcatgaatttcattgtatgtaaatgacatgtcaataaaaaaaatcaaaagtatcagacaccaaaataaatattcaaaatttatttttggaaaagtgttgatggctatattttacaaaatatttcaccctctattttcctgaaatacctgtccccctttggtgtacttatattatttgatttacatgaagctttgtaggaacacctctaaatctagatatgagaaatgcttattgtaccactatctaaaattgtgttttgtcacaaaccaagtgctttaagatctaaagatggtgaaggatacaacacatacagtctaccctggaagactatgtcattggtttttttgttgcacatacagtacactctattgctttgggatcaccaaaattaatcacttcaactaaaggtacatgttggtttttctccattccaagagagtaacaacacaactgattattcttagtgtgtgagctgagtaatgaaaaacctacagaaacatgaatataaatggaagtatataaactgtcatttcttaaaagtaggtcttcaggatagaatggggaaggaagaattacaataattaattgtaaacatttaagattctcagtgtgctaggtactgtgcataatgcagtggctataaattaatgaatggtactgatttgaaccacattatacctatttttctttatatttccaacaaatgactaacactattttatgatcagttctttttccactggaattactccattaataaatgactttttagatcaaatggctgtgaagtaagttaaaaaatatgaaaatcatatataagcaaagataaattcagggtgcttcttttttttcaattaatgccaaattatttttcaggatatgcagcattttataaaattcctaggcaagttaaagcacagatcaacaaatatttatgaaactcccatattctacaacactatattccatatggtaggataagcaacagaaacagtgtgggatccaaaggactttaattttaattgaggaactaaaacacaggtacatagattcgcatatatgttattaatgccatttcttcacagcaatactggcacatgcctgctcccttaaattactttgcctattcaaaattacctgtcaatgttagagttggcctcttgaggcccatttttctgaaaaaatgaagtgtatcattctgctcttaaacagagactctagagcccctttttcctttttcacaacagggttcattttagaaaatgtgtagctgccagatatgacaatgtaaaaaggtaggcagagaaggagataaacacagaaagaacagaaaggtgaattaggcatttaacaatttattcagaaaaatgtgccagcacctcaattttataaagtcatgggcaaaagcttatgaaaattgatttagcaaaacaaagcccagggaaatacaataatgcatttccaacttcacatggcttttatgtgaaattcttctatattaaaacatactataggccaggcaccatggctcacatctgtaattccaggactttgtgaagccgaggagggaggactgcttgagcccaggagtttgagatgagcctggtcaacatggtgaaactccgtctcaatgaaaaatacaaaaattagtgggtgtgatgctgcatgcctgtagtcccaactactgggaggctgagttaaaggattgtttgagcccaggagaccgaggctgcagcgagctgtgactgcatcactgtactccagcctgggtgacacagcaagatcctgttttgagagagaaatatatatatatatctgttctcacgctgctaattaagatatacccatttataaaggaaagaggtctaattgactcacagttccacaggggtgtggaggtctcacaatcatggcagaaggtgaatgaggagcaaagtcacatcttatgtggcagcaggcaacagaacatgagcaggggaactgccctttataaaaccaacagatcgcgtgagacttattcactatcatgagaatggcacaggaaaaacctgctcccatgattcaattaccttccactgggtccctcccatgacacatggggattatgggagctacaattcaagatgagatttgggtgaggactcagccaaactacatcatccaaactatatcatccccccggcccctcccaaatctcatgttctcgcatttcaaaacacagtcatgcctttccaacagtgcctcaatatcttaactcattccagcattaactcaaaagtccacagtccaaagtctcatctgagaaaaggcaagtcctttctgcctataatcctgtaaaatcaaaagtaagttagttacttcctagatacaatggaggtccaggcattgggtaaatacacccattccaaatgggagaaattggccaaaatgaagggactacgggccccaggcaagtccaaaatccagcagggcagtaaaattttaaagctccaaaatgatctcctttgacgccatgtctcacatccagggtacactgatgtaagaggcaggctcccatggccttggacagctccgcccctgtggttttgcagggtacagcccccctcccggctactttcacaggccagcattgagtatctgtgacttttccaggcacacagtgcaacctgtcagtggctctaccttctggggtctggagaacggtggccctcttcttacagctccactaggcagtgccccagtgcggactctgtgtgggagctccaaccccacatttcccctccacactgccctagcagaggttctctttgagagccttgtgcctgcagcaaacttctgcctggacatccagaagtttccatacatcctccaaaatctatgtgaaagttcccaaacctcaattcttgtcttgtgtacactgacaggaccaacaccacgtggaagttgccaatgcttggggcttgcatcctctgaagccatggcccaggctgtaccttggctccttttagccatggctggagcagaaatgcagggcaccaagtccctaggctgcacagagcagggaggccctgggcccagctcatgaaatcattttttcctcctgtctctgggcctggatgaggggggctgccacagaggtctctgacatgccctggagacattttccccattgtcttgatgattaacatttgacttctcattatttacccaaatttctgcagctggcttcaatttctcctcagaaaatgaatttttcccttctattgcatcatcaggctgcaaattttctgaacttttatggtctgctccccttttaaactaagttgcaattccaaaccatgtctctgtgaatatataaaactgaatgcttttatcagcatccaagtcacctcttgaacagtttgctgcttagaaatttcttccaccagataccctaaatcatctctctcaagttccaagctccacagatctctagggcaggggcaaaatgccaccagtctccttgcatagcaagagtgacctttactccagttcccaacaagttcttcatctccatctgagaccacctcagcctggaccttattgtccatatcattatcagcattttggtcagagccattcaacaagtctctagaaagttccaagctttcccacatcttcctgtcctctgagccctcccagtctctaggaagttccaaactttcccacattttcctgtcttcttctgagccctccaaactgttccaacctctgcctgtaagttacttccacatttttgagtatctttacggcagcatctcactctactggtaccaatttactgtattagtctgttctcatgctgctaataaaggcatactcgaggctgggtaacttacaaaggaaagaggtttaactgactcacagttccacatggctggggaggcctcacaattatggcggaaggtgaatgaggggcaaagtcatgtcttacgtggttgcaggcaaagagtatgtgcgggggaactcccctttataaaaccatcagatctcctgagacttattaactatcatgagaactgctcaggaaaaacctgcccccatgattcaataacctcccattgggtaccttccacaacatgtaagaattataagagctacaattcaagatgagatttgggtggggacagaaccaaaccatacacaaaacatatatatatatatttgctactaagaggattttgattgattgtactctattattggtaataattagacaaagtgggagctaggaacaggaaaacaaaaagaagataaagcaaatggcagagcagggtaaagaagctttttcatcaatattagatcttactactttttgtctaataagaagaaaggttcctgccacatacatgaagtatgcttccaacatatcttaacatcatttcactaggattaccctgacactgaggtggtggaagagtggaagtcagtaatcacaggtcctaacattgaaatttgacacaggaccttatgaaaaagccctcttggtatgaatataagctgcaaaaaagtaaaatagatgtatagcaatgaaactgaggaaaatagaaagcctaagaagtttctaatgatcaagtgattgccaaggaatgattttacaatgctcattattgttcactaagatgtgtaatatgtcatctctaacctctgtatagaatgttcagttttaattgctctatcttagcgaatcaaacttctatatttgataaggtcttttctaaatttacttgtgacttcagtaaagagaaaatgggtcctaaattagggtagtagcaatgaaaatagcagatcacataaaatgctgtgttctcacttcataagggtagatggtactgcctcaatacaatttaggggcgaatataaaaagtttcacatttgtacatgttgccatatgacacactttcagtggattcagaccaagatttttataccataagtagttttacatgggatctttagcacaaaaaaaatgacctaggtaaaaaatagttaaatccatgagatagaattggggtgaatatcaacatggagggattgaaaggataaggaggagtatccaatagagcagttaagagaagaaacacaagaaaaaagtgttacagaagacaaaggagaaacaggggtggttagaattgttcttcagcctagatgtacgagttacattgagtcagatattatgacatattacatagcctttctatagtggagaaagtcttgtaatattaaagggaaatataatgaaacagtgcaaagttaatacagaagaacaaatatctgaaggttttagctctggaaacagaaaaaaaaaacagtaaaatgctacaccactggttcaagacaaattacagtgcacataaaaatgctttgagctaaacactcttagaattaataaactgtctggttattcaatataaattcacttgatttataccaaagattcatctgcattctacagagggaaaaaatccattttctcttctctttctaaaggatttctggactctgaaagaaagtctatgatgattaataaaagtctgttagaaatttgtgttcagagaaaaaatgtaatcttttttttttgtcttttttttgagacagagtctcgctctgtcacccaggctggagtgcagtggtgccatctcggctcactgcaacttccacctcccgggttcatgctattctcctgcctcagcctcctgagtatctgggactacaggcacccgccactacgcccggctaattgaaaaaatgtaatattttgtacataaagatgatattacttccaggccaactatcagccaaaatggttttgaatttttttttattctatggaaggtacaatttatactgaattttctagaactttcctatgtgaagcatatcatacactaattaaatggttagctggagatagggacatggtgtatggcctgctccaggctttctccactttcatcttatcttaagtttagtgccatgataactgccacatccaaaaataatttaacagagatcatattttagaaatattaaactgatatatttttccatttcccctaaattatagtgacttgcatttccctacctattttattaaataacctatcagataaaattaagacaatctctggacagtgaggcttgttactcattttccctggcacacactacaaacacttcaaactctcctcaaagtagtgctgtgtctaccactttatggtactgcccaggcagtgggatcgaaatggtttagagagtcatctgagtagagaagacctgaaatggtctctctcaaatctcccacagtcatagagatggggtgaagaaccagaaatgtatatggatttccaaggccttttcaaaggtgaatggaacatggttgaaaattaacagtgagctcaagtgcttaaggtcaccacgttactactttgagtcaagatatgtttgactgtagagacaggtttatctctcttttcctcagaagcctataataatttccaactacctatttttataaactaaaattatttcatctgaagttccccttccccaggattttcaatcccttgattccacaacatacacatgtacttctgatctccttaatcgtctctacttctcatttaggttcccttgctcctgccaggctcctttccattaggtcatctatattgccagtttcaaaacctggtaaaattacctaaattatgtcttaatgaagtataacttaactttctggaaaacaacttggcaatctatacaaaagccttaaaaaagatactaacctctgtccaatgattccatttttctgagcaaatataataaaagatacagagcttaatgcataaagatatccatcagaacataattcagaagaggaaactaatggaaaccacctaaatgaatgtatggtacaatagggcgactatagttaacaataatttatagcatatttcaagataataaaaagagtgaaattagaatgctcctaacacaaaaaaatgataaatgcttgaggtgatagacaccccaattaccctgatttgactatgacacactatatctttgtattaaaatatcacttgtaccccataaatatgtgcaactattatgtatccacataactaaaaataaaaacattttttaaaaaagaatctcagtagggtggttagtcaacatggtacatttctataatcaaatattatgtaatcattaaaacagttacataggaatatactaaaaatataatgctgaaaaaagtacagtatgtatttattttaaaaattccaattttgagcacatataaacatatatagatatgtgaattaatatgaaaaaattcacaaaaatgttaactcatgtgtttattttcagtgctcattcatttaaaacattcactcacacccacacccacccacacacacacacacacacacacacacacacacgcttatttaccatctaacttctctaaacaaaaaaggcatagtccttactctatggagttgccggtctaatggggaaggtacatttaacaagtaattacaacagattatagtaacacattccctttttcttaattatctgtctctattataactgccaactccatgatggtagagatcctatttctcatgtctgtcccttgcatccacagcatctaccacagcgtacaggatcataaatatttcatgaatgtagaggaggcccagagactaaatgggagcatattagcaggagggcctaaaataactcaggaggtttgaaaacttttttgagggcaagtgccatttaaaataaactctaaagaaagaggaagaactagccaggtgaaggaggttgaaaacactgctcaaggtagaaaatggctacaggtaaaagaagtggtgttcactgaattcatagactcaaacagtggttatttccgaataagggtttgtaggcaatttctttttcaaatttacttcagtgaaggcgtatttttgtgtccatcagagaaacaatagtctaaactaaacagattttaaaatctctgacttctcagagatcaccctgattttacatgtttattttcttactttgaactgtctctatacatacaatatggaacaaattattgcaaattcagtgtcctactttagaactatcttatacttcctcctatattttaagttctttcgggtaaagaatattttttttttcctttcctttatttggtatcttccatagcactggtattgtgctgtgtacccagtatgctgtattttaaagttaaataattatagtcgagaatactgatcttattatctggtggctagtttttgttccaatgactttacagagttagtcccagagaaaccaatgagaattatgaaattttcttttatataactttaaaaaatttatctcgttcgataaaaatacttcataccgaattagaataaaaattaatattatttattatcctaaaatctcagagacagatgtttttatttttttccaggataaagagcaaagaaaaatattctgatggtcaaagtaaccatgactacggttttcagacttataacaagtgttattttcatacactctatattggtaaaaataatatattcttataaaatatatttgtggtgaagcttacttttatactgcaacaaaattcttaaaattattcattaattctaccatcagtagcttctagggtaactatttttccagtaaataccatagtgtggactcttgagagaccagaagcggtccctgcccccgaaaatatgtaaaattgccactctggttactactaagaccataaatccattttaccattgttacctcgattctcaagggtaaggaataattctcagcttccccattccaggcccatatctaaagggtagcacaagtttgataggggctctcttcgagaaagaggaacagtgtggcattagctatgttactagaaagacccaatccctagtcaaagccattgagtcttgcccctctacataaatggatatagaccctcacatctagagctgcattctaggctattaaacaatctttttcaattgctgttgctggtatctaaaatttcaaattatctttagacaatgtttcagcttctatgataacatttcagaaacagagcaaataatgtgtatggtttatttaaactatactcaaatgtactgaaaattggttcacatttccaaagaaactctgtgaataagtacagcatgctattatactttaagactgtcattctgttcatactaatataatggtgactttattactagaaacaagattttctctatctgggtaattttagttctgttcattttagcaaaattgtaatgactagaaccatcttggtggttgatctaaagcacacgaaatgctctttattttgccagctacaaacatgttaatatgaaatgcattcacagaacggaaggacagttcctttctaaagtactacggtttgaagtgaatagtcctatcatggcaaagcacaagtggaaggaaactgaccattaggtcactattggatggtaagggtatttcattccactatccaccccacaactcaaaagaggaatctgacctagtggcttactagagattggaaatgaaaaaaaaaaaaggtgaaaagaatttatttttatttatatacttggccagaaattagagagaagcttttataatacagatatcaaagggttctgaagaaaaagacatggagaaggactgaagagaagagaaagaagatgaagacaataacgagaaaagaaaaagaatgttagactatgaaagttttttcaatgaaaagagtcaaactctgtcaaatatttgaagagatttattctgagccaaatacgagtgagcaatggcccatgacacagctctcaggagatcctgagaacatgtgcccaaggtgctcagggaacagcctagttttatacattttagggagacaaaaaacacatcagtcacatacctgaaagatatacattggttcagcccaaaaaggtgggacaactcaagggaaatggggggtgttccaagctataggttgattaagaaattttctgatcagtaattggttgaaacagttattatcaatagaaatgaatgtctaggttatgataagggtttatggagaccaaagttttattatgcagatgaagcctccaggtagcaggcttcagagagaacagattgtaagtgtttcttatcagatttaaagagtctgttctatcagtagttcaaaaatagaggagagtataatgaggcacgtccatccctcaacccccatcatggccagaaccagcttttcaggttaaatttggagtgccctggccaagaggagaggtccattcagatggttggggttgggggggtcttataattttatttttggtttacagtcctcatgaagtacagtgatataataatcaaagaaaacattaattttggtagtcagagaccaaatacagatgactgcagtcagaatcttgtgattctgaattttagtttcctattgaaaaaagtttgaaattcagaagcacaataatataatttataaagaatacctaaacttacttcattaaggaaatgggtaggcatcaaggaatgaacattctctgcaacaaataatacactatggcaaataatttaatgttaaggtacataagaattcttctcatccgaatactggatatcaataaaagaaaacattgattgatttcaacaaatgatccttaattaaaacaatcgaagcgataaagaaggaattatcaaacataaattgctaaactagtagcagacagcttttacatttagcttcatttgttaaatgaagtaaaatgcctatcttacttcaaagaatgttttaaaaattatatcagtaggattaggttgtgacaatagcatttaaattccatgagaacttattataaggaaactgcctaccctgacatttcctccatggtaaaagaaaagcattcttatttataataaataaattttctttagtctttttcagtttacaaagtgcctgtatacacattatcatttatgctgacaagcagctggtgcagtgggtgtttttttttaatctccgtcttgacagagagcagcaaagcacacagtcttagatgctagaatccatgatctatcactgaatagtttgtgacttcaggcaagttatttaaactctctaaatctcattctccccctatctaaaatgggggtatttatctgcctcatagggttgttataaagactaaattaaccaataactgtgaagtgcttaaactgtcaagtgctggagttagctgttattactacagataaaactgaagtggtcctgaggatgaggagaaattggaaacttcgtgtactgttgtaagaatgcaaatttatgcagtcattatgaaaaacagtatgaaatttcctcaaaaaactaaaaatagaaccaccatataatttagcaatcccacttttgagtatttatctaaaggaaataaaatcagggtcctggaggcacttgcacaatcatgttcatcgcaacattattcattaacagccaagatgtagaaacaacctaaatgtctatcaacagatgaatattttcatcagaaaaggtgatacacagacacacactcatacggtggaatattattcagcctttaaaaagaagtaaatcctgcaatatgtgacatggatgaatcttcaggacattatgcttagcaaaatacaccagtcacagaaggacaaatactacatcattccacttaaatgtgaaatctaaaatgatcaaactcacagaggcatagagtagaatcgtggttggtacgggctggggagaggaagaaatggggagttgctattcaatggatataaagtttcagttatgcaagatgaataagctctagaaatctgcagtacaaataccatgtttatagtcaacaacactgtactgtacacaaaatttgttaagaaggtaaatctgatgttaagtgttcttactataataaaaaaaaattatggttcatagaactggcctaaaactacagagtaaataatcagaagagtcaggattcaaattctaatcttttacataaggtcaagtgactttaagtaaaccttaaaatctaatccacattagttaaagcaatatgttattcctgaaagagcatagactttggtgcagacttaggcacaaataatagtttaactcatcagtgaaatagagacataaatacctaacttgtatagtcatataagaattaaatgagaacagaaactccatgagaccaaaatgtaagaactttataaatttaaaattgatgtcttgcaatatgtggcctcactgaaaatattttaagaggtccctaaacctataatgttatggttaccagccacaaaagacatatgagttagtaagatcttacaagattgtttccttaatgcaatagatgctaatatttggacaagcttcaatgagaatttactctcgtgttattagaaaattgtgtgaaaatagtatgaattgttccaattgcctgtatattttatatattctttttctagtaaaaaatgaaaagtaataagatgaatattttattttaaatgctgaaatgtacaaaacacatttttcagaaaagaggaaatcttattagtattagtatgtatcaactcattttagaaaatataaaactaattatgtccaactgaacaaattaacaccatcatagtctagctaagcattccaaggtcgttcctttaattttatgatctcgcacattaactcatattaaagaaaagaagattcaagtaaatctacttgggttaaaacatgcccctgtataatacctcttaacacctttaaataaatgattcaaaacaaaatacatatgctttgtgcatagtacatagcatacatcttttattgtactaaaatatgcaactaatccttcaattcaaccactacattattcctggggaattttctcaccaacttttgaaattacaacctaagtttttgtaagtatccaaaaatcaacacagtttggttcattggcaaatgtttgtgatatcaatttaaatagatgcatggcatctgtgaaatatgagatgctgggctccacagctagctatgaaataattttaaagccagaaactaccttgccaaaacaaattagttggtagactcttcgatctgaataacaatgtatatttttattttcaataaatagaaatatattaaatttctagcactgccacaacaaactaccataaattgagtggcttaaaaaaaacaaaaatttcctatctcagttttggaagctaaaagtataaatcaagatgtgagtagaaccatgttccctctaaaggctccagagaaggatctttccttgcttctttcaatcttctcatggtatcatcaatccttggtgttccttggcttgaaggtgcattaccccaatctctgcctatatactcatataaacctttttcctgtgtgtcctgtgtgtgcctctgtgtcctctcctcttgttataaggataaaaaatcatattggatttagaacccatcctactctagtatgtccgcatcttaactaattatacctgcaaagcccctacttgcaaatatggtcatattttgaggttatgatgaacatgaattttgacctagtatgggggtaggtttatgcttatttcatgcaattttaatctttaaagtatgtttaagctgtaaaattctgtgattccataattgtgagaccaaaaaataaactttgtctagcacaaaaatgcacaagttgttttctcaaaattagtgattttctcataattaaaatgtttattaccaaatcagttaatcctatatgtaaacattacagtacttcctcatgtttctggactttactcatgtaggtctttaatttcactacgctacttttacctcaggatagggcaaaaaagagaagtaaggaagcatctatattgttaggatcagagtgcaggaccgaggagaccaggagaggatactgatgagcaaaaaatgaattcattccttttgagtagattcctaggagtggaattgctgagtcatatggtaaatttatgttttactttttaagaaaacacaaactattttattgaaatgactatgcaattttatatttctaccaacaatgcataaaattctagtttctccacatcctaaccaacactaatattgtccatctttattattacagtcattaaaattacattataattgtaatctgtattgctctaatgactagtgatgtgccaggaagtcttcttagtggtcgttataaaaggtgaataatacataatacttgcctttacaacatttaatgtctgagggagagagagagagagagacagagagaagcaaaaattacaacacactacattaaatgtacacacactgttataccttttactaaatagttttgtgaaatttggacattttcccttatgaatgaagaattttgtggaaattcaactaagattaaacaaagcccaacattatatacaagccatcaacctgtgaagtatttcctccatgtacttctgatctttaaagcaatcatgtaagacgttctctcaactaagtacttcattttctttaaaggacatttgcaatagaataaagtacaaagtaatgctgcatttaagtgtcctcagggaaaagaaatgaacattattattttagcagaatgtccaaaaggtgattttaatgacaatagacttttctgatgatgatttttactgattttctcatagataaaatgtttattatcaaatcagttaatcctatatcaaatggtttctataataaaaataccaaaaatatcaaatggactttcaaaaacatcgaatggcgcctataaaatggagatcaaggcacatgaaaggatctctagcactcagcaatcctaacacttctattaaatatggaataattctatacctcttgacctctatgattgcaaagccatgtaaatgagctgtatacatagtcattttccttaaaccaagtgttaaattattttttaagtctctcagatggcctacctctgaacccagtaaaaactgaaataggggtgagaaaatgctgacctcttgaattatatacaaagttgaaaatattcttaaggccctaccaagaagtagagaattaccatctgagtcttgtatccatcagaactccagtctggagatgagagctaatacattgccacattagataaaacatatagataaaaatatgatgtaacatttttttgaaggatgaatgaacacaggaataggcattgtgggagctccaggtaagggaatagtgacttaatagtagccaggcactgggtattacaagaattcctccttccttcaaagagctcattgtccagtgaagagacagtcataaatacaatgaaaatacagtaccgtaaaagcagctaacatttattgaacacattctatttgcaagctatcatttttacttagattatctctttcaatcctcacaacaaaactacaagatagataccgttactatcctcattctacagatatggaaacaggcttagagacacaacttgcacaaggctacttgacccacctctaaccgattcaagtggcccatattcataaccactgaggcagctttactgccacttataccactactataaacatacagatgttaaaataaacatagcaggcacaatgggacagagggccgacttgccagagagagtcagaaaaagtttcacagagtgtgctctgaaaattaacaagaattttccagacagagaaacagaggagaagcattccagattgggggcaaaaatatatgtgataaaaagaagcatacacggaaataacagaaacaactgttgtattagtttcctatggctgctgtaacaaaataccataaacttgttacttaaaacaacagaagctattgcagttcatagtttgggatgccagagtctgaaatcaatatcgctgggccaaaatcaaggtgttgggtgggccacgctccctccagaggctctaggggaaatttcattccttgccttttttcagcttctggtgactgccagcatcccctggcttgtaatcatattgcacaatttttaagtctagcatcttgaaatttctccatgtctgtaaagatctccctctgtctccttcttataaggatacatgtgattgcacttagggcccacctagataatccaggacaatctcccatctcaagatccttaacttaatatctgcaaagaccctttttccaagtaaggtaacatttactggtaccaagaattacatctgatttctttgggggcatttttcagtctatcacaacagtgataggggagtccatgttggtagaattggaaaatacacaaaggagtaaaggtcatgagaaatgtggcaggtgggaggggtaaaatagaagaaactaaaagaggctagcaggtcagcagggaccagatgatgatgactagattggctacagacatgtttaaattgtattctgtaggtgacaggtaaaattgacatgttttgatttgcagcattatattgtgatatttgcctgttagaaaaaaatcactacagagttaatagtgaagagagatcagtagaaggcaagagattattgaaacccttaataattattcaggaataaaaagaagagatggataagatataaatttggccattatggatgaaatatagagaaaagaacaaggagaaatttaggataactcctaaatttacagttttgggcaactgggtggatagtggggataactgtgaataggaaataccataggaggtactaaaggcaaggatgaacctggctttggacatgcaaatctagaggtgtctgcatggcatccaaattgagattctggtagataaattgatatgaaagtctggagtacaaaaggatttagaacttaaatgtatacatctaaatttgaaaatttagagatctagatttaggaatcactggccatgagtatagttgaaagtatcaaataagtcagtgttagtagaaactgcttttattgctggtcccagtgagttccaaggcagtctcttcagaatttttatgctgccatgaatgtttcaatttgttcattggtgaattttagccacctagactgtatctaattatctcattttctttagacactgcctgtaccattttggaaaattatcttattaaagtcagctcagaaaaaaaaatagagcatttagtgttctatttacatgtgattatacatactcagggtcctggtgctagggacctcataaatgctgaaaagaactgttaatcttaaaaggctttgggaaaaaattattactaatattaaccctctagggaactaatgatgaaaaattaccctaccccagtggtccttaaaactttttcatcccgtgactactcaagctctacatcatttcttctacaataccacatcacataactgcaggacttttatgccgctgcgaagggaagaaagagattatcatcttcatgagaccacagggtacactaaataaatgttgaaaacagagcaccaggcagtgactgagaaaagctacaggaagactgcagagcctgaggctttgacaagcaggtgcttccgtggtcatcaaatcactattcatagacatgtcgttccaggccagagaatccagctctgagaaacaatgcctcagccattagctcccaaaagacatcaatcacgcctgccaagacacacagttagctcaggagggatttcaaaacttaactgggtcaaaaattgcttctaagcaggttttcttaatctaatctaaactgcaacttgagaaaatagaaggaattctacctccttctaaactgtggttcctacctacatctccaacactatttttatctcttttgttttccaagtacaaaatgttttgatccaatgtaaatgagctatgtattgctttctataagacctacaaattccttcctaccttctcacatcacttattctacccagaaagtcttccctttcctccttctactttcaaaatacaaatttcatagaaatttgctgggaccatgccagatagtagtcataatgcatcttcaatatttctgccataattgtaaaatttggaactcagtaaatgctgtcttgcatatatttgctttctgtatatgttatatgcctctaacaagattttaagttctgtggatggagtcagcatttaatatcttactgggataccggtgtccagtaggtctcaatagatgaggatgacaaagactccaaaatatacatctgccttttatttctgcctacgaagattttaacaaatttttaacctgtgtaaatttttctaactaaaattttcacctctttcttaccaatatagttttgttttcatatatgagatttccttactatctttgctttaataactattttatctcaaattttaacattgcctggaaaaaaacagatgacattgtagctttagattaattttcaaagtatctgattattttaatgtatcaagagaaagcaggaagagtaagagattgccttttgtgctattttgcatatataattggctttacacaaaaaataatgcatcctgtaaggacagaaaaggtgtaaaatctttcttcactcatcataaggatcacggtcaacactcttataataaaagacaagataacaagagaaaagcataacaggtttatttaatcaaagttttgcatgacacaatacccttcagaaatgaagattcagagacccaagggacaactgtcaatttttatacttagattcgatgaagaatggacagttgtgtagaaatgagattggacagaaagggtatgacctaatggtagactgagtgaggaaacctagtaagacctcctgttcttattcttcttgaactctctgtatagcagttcttggtcctaggtataggtccggaccccttctgaaatgagtcttgtgacctactataagacaaggtagaccagagtatttctttgtggccagctcttatacaaaaagctgggagaaagttagggtaatatttctaggttttatgtctggctttaggggagagggtttctagtttctatggcctgccttgggagagaaaggggagcaggcataaaaagggcaggagaaggtcagaaagatcttgcttctgtgacctttttctttagttcaacttattcagcatgctaaagtgccatactttgtggtaccattttctgagcccaacattcccccatctgaaacttccccagaaagtttaacagtaaaaaaattgggttgttggattgtctcataagccatcaaatcagtctttcagtcctgaaaatatgtctgtccaattagacaaataatggttgtgtctaatttgaggaggtggtattgcaggtaggcctccaccaaacttagtcctccatatggtgtgagtaatcagatatttaacaatagtcatttctataaaaacaaaagaaaacaaaaggtaatgtttgaagtaatccataaactcattcctgagtccagagggtatccaattgagacaatttctagatttggcctcaaagtatcttcaggtgaagacagtgcaggcagtggcaatctaacagctttttcttgcttttagttttcaagtgagctttctgagtaatctatacagcaacaggcatgaaggttgttcatacaaaagctgctgtggtgatttccctgaagtctacatcaagtcatcaagctttggctaattttagggcttcaggaaaagaacagttttaatttcaatgatatcaagccagaagggtgggagaaaaattaaaaatattattttggagagttgtggccagatattagaggaaactagaagaatttcagaatacagcccagatttcaggtagatatggaccctcaaaaacaattagttagaatctaataacaagtgcactatagttttcatctgacacataatttttctctctatacgcactttcatttctagtaaagatactcaaagtagactgatttgtttgcaaaataagtttagtctccttaaacttctcctgattatttacataaatccagcaaaaatatttattgaccattttctttgagatgagtcttgctctgtcgccaggctggagtgcagtggtgtgatctcagcttactgcaacctccacctcctgggttcaagcgattcccctgcctcagtctcctaagtagctgggattacaggcatgtgcatattggctctttttaagtttgttttgctgaaattttcaattaggaatctcagattagacttttaaaagcttcttgaggctaggaatccaagccaaggactcactgtcaaatttcccatagtatctatatagtttggtgaattcctctctgctcaaggggtccaaaatatcctgaggtttcagggctgtcagaaagtgacattctttagccatctataaggcaaccatgtgaactttgttcaagaaaccatgccagttattgcaaagcgggctttattggctccataatgtcaaccttagttcctcgatgttgtctgaaaatatgacattccagtcaaagccttgataacatagccagtgtttccaattgtgtcatgttacaaggagaacaaattcttactgaagttacacaaataataatattgccataaaataagaatccttacaaatagtttctgaattctggagggatacagtagaaaaaaaaagtaaatgttttaattctgtttacaaagttatactttaccaaattgttataagctatagatgccttcagagaaaaaaaatctttaaatatagaaaataaacatttaaaataagaaccagaaaactttcaaataaaaagtcatgaaaacatttcctcatcagttgattcagtcctgtgtaattaattcttattatgtttgatcttggttagcagtctcattaagtcatctgtttattcattagagttgtggaaattcttacctagtccaatgatatgatcccaaagttatcagaaacctgtacttgtcagagttatttccatcctttccctgaactttcttgaagacacaacactttacaattctagttgcttgcaaaaacttttcagaaagatcatcagaataaagcaattaactatagacaagacttaaaatgatcatggttagaaatctgttaagagttcattataaccagcaaatgacaaggaaatttggtgatttctgtggcatacaacattttaacataataaccaaaaattgtgaataatagcatatcagacttctaggaatctcataatttttaaacactcatatgaataacatccatagatataacttacaggtttagcatcccttattacttgacaatgcttcccatataatttagcatatcaaataagccaactggcttatttgaggccaactggaaaatctcaaagttaatttgggtcaaaaagacttaatttagaatttaattttgagaactttgtcaaaaatgtcaaaagctttaaaacacttggttaaatattatcttggatatttattaatcaaaatgacaataaaaaatgtttaagaggctgggtggagtgcctaacgcctgtaatgccagcactttgggaggccaaggcaggtagatcacctgaggtcaggggtttgaagccagcctgaccaacatggtgaaaccctgtctctactaaaaatacaaaaattagctgggcatggtggcaggcatctgtaatcccagctacttgggagactgaagcaggagaattgtttgaacccgggaggtggaggttgcagtgagctgagatcacaccattgcactccagcctgggcgacaagggcaaaactctatctcaaaaaaaaaaaaaaaaagaaaagaaaagaaaaaattgtttaagacaaatagagaaggttacatacttgtgaacaaaaactgagctcttttaatagaaaactcagttttcttaagtaatcaaagactaatatgtgaccacatgaaataaactacattaataaaacacaaaattgtttcctaggccaattacataaaaggaataaaaactgtcacattctcagaccaaaatactccaagaaacttttgtcattttaacagggaagaccaaattgtacttttgcttcagtgtactcttaacactaaaggtaattttaaataaattttaaataaatatatacaatctcagtcagctttgaccacacaacattttcataaacattttttaaacttttaaaaattgatacagaattatgcatacttatggagtgtacattgcatatatacaatgcaacataatcaaattaggataattagcatatacattatcctcagatacttatcatttgtttgcagtgaaaacattaaaaatcctctcttctagctattttcaaatatataatacattattgttaactacaatcattctactgtgcaatggaatactggaaattattcatcctatctagttgtaactttgaacccactgaccaacctctcctcattttcctctcccctctacccttcccaacctctggtaacaactattccactctctagttctatgagatcaacttttttagctcccacatatgagtgagaatatgtagcatttgtctttctgtgtctggcttatttcacataacataatgttttccagcctcatccatgttgctagaaatgacaggattgtattcttttttatagttgaacagaattaattgtgtaaatatgccaaatattttctaaatccattcatccattgattgacatttcagttgattcaatgtcttggcttttgtgaatactgctataataagcacaagtgtgcagttatttttttgacacactgacttcatttaatctgaatatataccctgtagtaagattcctgaataatatggtagctctatttttaattttttgatggaattccatgccaatttccctagtggttgtgctattttacattcccatcaacagtgtataagagttcccctttcttcatgtcctcaccagcatttgttatttttgtctttttgataataaccattctaattactgtgatgtgatatttcatcgtggtttctatttacatttctctggtaattagtgatgttgagcatttttccatatacttcttggccatttgtatgtcttcctttgagaaatgtctattcagatctttcacccattttttttagtgaaattatatgcttttttcctattgagttgtctggtttccttatatattctcattattaaccccttgtcagatgcatagtttacaaatgttttttggtataacataagcatttttcctattttttaacaaaaatgtgttctttattcattatgaaacattttacttcctcacaaagagttgtttcctttataatttctagtattttaattacatgtattaactataatttataacttttagtaacttaatttctagttaaaagtagcaaactttgtgaactgtctcatattagtacaaatgatttcattatttctagagacatgcatttcctcaattttttacatttattaatagatccaaatatatttagcttctctatatcttataaaaagaagacgccaaagtacataaacttatgaataatcatatatgttttcatattttaacttacttagaaataactcagacaattaatgagtatctctattacttaatttcactataaggtttcaagttaccaaaaagaatttttaaactatgacaagttcatttataaacatttatctcattcacatttacctaactgtattcattcttaacagttatgtttaaattgatcatgggaaacaggctattcatcatcttatctttttgttcttttaaaaaacaaaaccaaactaaccctacatttgccagccttgtcctaaccaaagcctctgaaacactggacacagataccctccccattgttcaccccagccatcctgggtcctaaacatccactcagcacccagaaggctacaaaaggcaaggtccatatggatggtacagagctcaggacagaggacaggaaacagacagctgtgaagacaatgcctggagtacttgactgctcccaggatggccaagaagcagagttaggccagggaggatggggccatactgggcttggccctcccctgtggttgactggcagcctaggcgctgcagaaacacacatgtcctagacttcaccatagcctccttcccagaccccagaatccagaggctcaaaactaaatacataggctcacaagatgtacacaaggctttatgggagcctagcagtcattccccctagctttgacctaccaataagtcaggcaagtatcaaaaatatcaaagaagctaaaagttaaaagttaaatgtagtttttcctttttttttttcccccatgactcatatacattttagcaatccatatttactgtgcattctactctgaggttggatttaaagtattatgaccttaaacacctagcagaggtaacatacctgtttgatcagcaaacacaggcaaaaatgtctatattatatttaatgacataatcatacagaaagaagcagatcctacagctttaactttaagccacatgccaggtccaataattcaagactcactagctggatttggcgggacacgttacctgctccagatggctagagctttttaccaatttgtatggagaaggcttctgagacttttcatgggaccagtttctaaacatttttttctttctgatgacagtcatctccctgaattttgtatttccagaagataaatatcaagttctagagaagtcaggataggaaatttacatctcaaaagcacagagaaagaatgcaagttttttcatgtagtttgaggaatgttcacctattaacagagatcagtcttataaaggatgtggactagattttaggctggtaactgaggatctagtgtatgaatgtcttcaaagccccctatgagtggtacaaaaagtacataaatgagcctaggcaaaaattcaggagtccattcaaaataaccagctgatcccattattacattgggttttgggtctcttagagctgaggtaaaagcctaagaggacaacatcccatagttgggtcatacaacattttcacaatgtaccttgttgcatgggcattttcttgaggctagtgtgtaacctaatgtcaattagcccattttgtgtcccgcttatcctaactcaggagtctctgtctttgtgtgcatgggtgtggtaagcactctagtagctttcaagtgcgcaaaccatgcacaccatcaaattgtggctttggctccgaaattcctttgaccaacttagccaatgattttcccattctgtctgacccagtcaaacacctgaggcttctcttatgtgagggcacaagaaacaaagaggatggaaacaagatataatacctgtgaatttggaaaactggagttcacatcccctatagcaaaaaccacttacaaaccacttacagcaaccgctgtctgttgtattgaaaactgcagctctacccagtaactggtcaaccaccatgaatccaaaagtcaaatgccttctcacagcacaaactaacccttggtaccccaaatgccaaagatatcagggagctcaatgccaaagagaacagaggtccagatgtgagaaggactaactcatgactcttagggaagacacaggaccaaatgaggaagacagaggaccacaaaaaggaggtcaggggcacctttcctgtgtttttcaaggggtctcagagtctttagaggtctccttccggtccctatgtatgattaccagaatgctgatgttttctcttagtaattttttatctgctgaccaacaaatggaggagggaaggagttgaaggcccactcaaggaaactgaatggaagatagacggtggcacaaggaggatacaggagcagaagaaatggaaagaagaggtttagaggagtcaatctggggagatcttaagttcaccaaaaaggccaataaagttccacattgtcctcaacaaaaatcacactaacaaggaaggaagtaaacagaaaaacagaatatgtagttagcaggagtttgagaaaaggagtttcagttgactgtgaagttcccatgggagaagcaggatccaacagagaaactcagacaccttagaaaaagcctgaatatcagcttccacttaaattgacttttcaccatacagccttttaaaaaaatcctttcaaatgtcttattatcagatttcagccaggacaaacaacaaataattctgatttttttccttttccttttaaaccaaaggaaggtatccatcaagtaactcagaaccaaaaccagtaagtcttttacgacttaaccagtgatgagagagacgtcctcaagagggtgcgaaaaggtacagtcctccaaagactcagaaccactcccaaaagaaaagtcaaaagaacgaaagacctttgctaccacaggaccaagcaatgatggtggagatgacaaaagcccctttgaattgggactttttataagaaaaaaaaaaaaatcccctgagagctggcacgataaaacagagagcattcagggacctcatccactggctgcctgacacaagccaacacttgtgctctctggctgacagagatcaggggggatattctcacaagtcttaaggccgaactctcaggatgtaaaaacgagacaaacaggaaagacaaagacaactgtccctgagagggaaaggatccataacaaatgggtaccccaaggctaaatttacacaacagtcacaatccaaacaaatgattttctcctgctaacctgaatttggaaaggaacaaatacagataaaattttaccatctattctcaaccaggcattatagacagagaccagggaagagctgatgttagtaaataattctccctttgccggcttttggtcagttgtcctaggatctcacctgcaggcactggagtgagtcagttgcctcagccgctccacattgaacaccagagttacaagcgcagaaaaggtatgacacctttcctacctatcaaaagggtcacaaccaacactcctacaagaaaaggttaacaagaaaagcataacagatttatttaatcaaagttttatgtgacacaatagccttcagaaatgaaggcccacagacccaagaggaaaactgtccatttttatgcttagatttgatgaagaatagacagttatacagaagtgtgattgggcaaaaaggatatgacctaatggtaatagactgagtagggaaatgcagtaaggcctgtcctcattcttcctgacctctctgtgtagcattctttcctcatgggtatagggcaagaccccttctgaaatgagggtcttgtgacctaccattagacaaagtaggtcacagaatttctttacagccagcctctacacagaaaggtggggaaaggtcagaataatatttccaggttttatatctggcttttggggatagaagttctaatttctatgaaccaccttggtgaagaggaattctagtttctatggcctgccttaggggaaaatgggaagcaggagaaagaagggtaggagaatgtcagaaagatcttgcatctgagttcaaagtattcgcttcagtccaaagtactgagaatgccaaagtaccatactttaagaaataattttctgagccccaacaatcctaatttgaaaagttaatttataggattcaaccttttttatatcagagatgctagctgggtagaggtgtacaacaatgaatgaaaacagaaatttttgttactgtagaactctttttgaggaagtcaagaatatttatgagtatgccttttcttcacagcttaactaaaggtctgttaacaaatgtaatagagttaggcagtatctttgagataaggtacctcaaaagtccccaaaggttcttccaaaaacactgtcactgccaaaaaaggttctataatcacataagtttaggaaattctccctgttctcttcccactttggagacacatatcatgacatctagtccacaaagtccagcaggagagacctcttcaatttcataaacatatttaactacaaacactttatatcaatagtgcctaataatagtctagaaatcagaactcgtaatcgtaatactatttaggcaatgttgatctggtataaaacccttattttacagatatttttaaaagtaagagtcacagaagttaaatagctatctagttcagatactctagacagagccaaatgaacccaatctcccaattccacgtttcttccatgactcattctttacatgccaggcatttaacctaatcatcactttgtaatttaaaatttccccatccagcctcaaatacatgtttgtttgtttgtttgtttaagcacacaataatatacattttgagcatatccaaagcttatctatcaccctggataactttctgtaagtgcctccctgtttataaaattaaaaacactgaatctgatagcaaataacctgaggcctctgtgataaatgagacagggcttcggggcgtttcagccagcctcccctgagactaggtttaagacatctccatcttatgtgaagacttaaattgtgttgtagcagcttcagtgaaattatttttaatgcccatttgagattttttagaaataatagagcttttatgcaggcattcgaggcagaatccttaatgaggtaaggcatgaggaatgaattcagaaggaagattttcatgattggaggagctatgcgtcatacctaatgtacattccaggaatattttatttaaagcaaaattagtgaaatatcaatctgtggaattctacaagaaattcattttataactcctccattattcctgtcatcagtaacttcatttttcacatatgagaagttctcacgtaaatgtcctgaatatctaaaccaatgtattcagtgcccagaatatattatacatccaggattcacaatattcacttaaatatgatgattagagcaaaattgtcagttaaaaaatagcagcagtatttagctgcatttgagggaatgtgatctgaagtaccacagcaacctttcttaagccccaagcaatgcaaagtcatgacatgtacgggttcagagacacagagctgattgagcaaaatacatatcccaaagattaatggtcatctgaaagaagataaaagatttattgtaagtttttatttgacatagtgtcacacaaaagtgatctatgatgtcttcaataacaaccaccaccacaaaataatggctaacacatctaatgctcactgtgtaccaggcacagttctaagcactttctatataatcactcatttcattatcataacatctccatgaaatagtactactattatctccacttaacatctattgaaactgagatgcagagagtttaagtaacttgccaaaggtcacacagctagtaagaaacaacacataggttggattcgaatcctcaaagtccagctccaaaatccgcaatgtctgagccttactaaatgccaagcaccatgagaggttctttcttgcattacctcatttcattatgcttatttaactttatttttaggataaaatcaactgtaaaatgtttttctctttcatttacaagtttgcatggcttgtggctacatccttgaatttatcagtaaatctccaatataataaaaaccagctgtgttccacctgaaacattaaaacattattctttgcattgcgtaagttaaaaaaactgtttagtttctacttctctagcctttcttgagtaagcagctatgggtagtaaagcatacaggacaaagagatatctcaggatccagctcacccaatgagggagctacaaaagacagcaaggaaggccttcaagtaatgagttagcaagctgtctagtgataaccctgagccaatgggaatgcccttgggatgtgtcctatgcttaattcaaatatctgtggcacagcatagcatccttgaactgggagaaacctctttgtagcattaccaccaatctttcctaagtaaagttagccatttccacctcagtgaggctaatcttcaagtaatttctattgttgagtaaagaaggcattttcgactattattcaaaagtcaaaaaaataacagacgctggcaaggttgtggagaaaaagaaatgcttataccaacgctgttagtagcagtgtaaattagttcagccattgtggaagacagtgtgatgatttctcaaagacctaaagtcagaaatatcattcaacccagcaatcccattgctgggtatatatccaaagaatataaattgttccattataaaatacatgcacacatatgttcactgcagcactattcataatagcaaaaacttggaatcaacccaaatgcccatcaatgatacaatggataaagaaaatgtggtacatatacaacacagaataccatgcagccataaaaaaagaatgagatcatgtccttttcagggacatggatggaggtggaggccattatccttagaaaatggatgcaggaacagaaaactaagtattgtctgttctcacttataagtggcagctaaatgatgagaatacatggacacatagaggagaacaacgcacactggggcttatcagggggtagagggtaggaggagggagaggatcagaaaataactaatggatactaggcttaatactttggtgatgaaataatctgtacaacaaactcccatgacacacgtttacttatgtaacaaacctgcacatcctgtacatgcacccctaaacttaaaaataaagtcaaaatatatgcatggaaaaaaaaaagtcctgccaatgcctgaaactcaacatactccaaattaaatttaccctatcctattccaaaaagtcaactttattttcaaagttttctaaatatcccagatttaaatgattctttgattcctaattttttttttcaccttgcatattaaccagtcactggaacccaacattcattcatttatttttcttcacaacgtctctcagattatctttcctttctgctttcgaggcaaaacagcatacttgaaaatccatagaggctgggcatggtggctcacaactgtaatcccagcactttgggagtccaaggtgggcagatcacctgaggctgagagttcgagaccagcctggccaatatggcaaaaccccgtctctaccaaaaatacaaaaattagcctggcgtggtggtgcatgcctgtagtcccagctacttaggagactgagacatgagaatcacttgaatgcaggaggcggaggttgcagtgagttgagatcacaccactgcaatccagcctgggtgacagagtgagactctgtgtcaaaaagaaaagaaaaggaagggaagaggaggggaggggagggaaggggaggggaggggagggaaaatcaagcccacacataggagttaatgtaggtcctggattttccatgtactaacagcaaagaaaaaaaaaaagaattctcagtagaggatttccacttcctttctactttcacatgactgttcctatacaaatgcaccaacaattttattgaaaatggttttttttacatgtagtatatttatgtgatctctactgttggatctctctattgtgtatgtttatactgaaccaaatctttcagtgactctgttcatgcttttcactcatttcatccatttctcattatttcattattcttcccatctcaaatcagtagtaatatttctaggattttcataattcaaagagagtgaaaatattcctttcggttctcttaattaattcttcctcaggaaaaaaaaaaagttgctttagtttaaggtttttccagtctagaatgaaatgaatctcaagaaatctcaaggatctccaatgaaaggggagaacttgcacccccaccttgaaaattacttcttacgcaatgattccatccattactgatatattgtatcatgaaaatagtgtttataaaaactatgggaaattttgaaaaatgcttgttaactgcaaaagcagaattccaaagtgtttacacagatgacattaggtaggtaggtaggtaggcagatagattacacagacagacagacagacagacagacagacagatacacacacataaactcatgcatagaaaaaaatcaagaaaaaatcatcaacataattttgttgggataatatgacttgttgtcctttcttatatttctcctcatttttcaacttctttgaataatcacatggcacattcaatagttaaaaaaaatgaacatttactttgcagaatacttacacatcaggcaacaaaatatcactttcttccaaagtactgaaatttctctgaatctagccctgtagctaaacaaacctccctgacaatgtaatgttctggtttgggagtctgtctttacaaatccatcacataaacagaaccaatgacaaaaaccacatgattatctcaatagatgcagaaaaggacttcaataaaattcaacaccccttcatgctaaaaactcccagtaaactaagtattgatgtaacatatctcaaaataataagagctatttatgacaaacccatagccaatatcatactgaataggcaaaagctggaagcattccctttgaaaaccagcataagataaggattccctttctcaccactcctatgcaacacagtattggaagttctggccagggcaatcaggcaagagaaagaaataaagggtattcaaataggaagacaggaagtcaaattgtctccgtttgcagatgacatgattctatatttagaaaaccctatcatctcagcccaaaaacttaagctgataagcaacttcagcaaagtctcagggtacaaaatcaatgtgcaaaaatcacaagcattcctatacaccaataatagacaagcagagagccaaatcatgagtgaactccgattcacaactgccacaaagagaataaaatgtctaggaatacaacttacaagggatgtgaaggaccttttcaaggagaactaaaaaccactgctaaaggaaatcagagaggacacaaacaaatggaaaaacgttccatgctcatggataggaagaatcaatatcgtgaaaatagccatactgcccaaagtaatttatagagtcaatgctattcccatcaagctaccattgaatttcttcacagaattagaaaaaactactttaaatttcatatggaaccacaaaagagcctgcgtagccaggacaatcctaagcaaaaagaacaaagctggaggcatcacgctacctgacttcaaactatactacaaggctacagtaaccaaaacagcagggtactcgtaccaaaccagatatacagaccaatggaacagaacagaggcctcagaaataacgccacacatctacaaccacctgatcttcaacaagcctgaaaaaaacaagcaatggggaaaggattttctattcaataaatggtgctgggaaaactggctagccataggcagaaaactgaaactgaacccctttcttacatcttatacaaaaattaactcaagatggattaaagacttaaatgtaaaacctaaaaccataaaaaccctagaagaaaacttagtcaataccattcaggacatagacatgggcaaagacttcatgactaaaacaccagaaccaatggcaacaaaagccaaaattgacaaataggatctaattaaactaaagagcttctgcacagcaaaagaagctatcatcggagtgaacaggcaacctacagaatgagagaaaatttttgcaatctatccatctgacaagggctaatatccagaatctacaagaacttaaacaaatttacaagaaaaaaaaacaaacaaccccatcaaaaagtgggtaaaggataggaaaagatacttctcaaaagaagacatttatgtggccaaaaaacacatgagagaaagctcatcatcactggtcattagagaaatgcaaatcaaaactacaatgagataccacctcatgacagttagaatggcaatcattaaaaagtcaggaaataacagatatgggtgaggatgtggagaaataggtacacttttacaccattggtgggagtgtaaattagttcaaccattgtggaagacagtgcagcaattcctcaatgatataaaaccagaaataccatttgagccagcaatcccattaccaggcatatacctaaagtattataaatcattccactatgacgacacacatggatgtttattgtagcactatttacaatagcaaagacttggaaccaacccaaatgcccatcaatgatagactggataaagaaaatgtggcacatatacaccatggaatactatgcagccataaaaaaatgagttcttgtcctttgcagggacatggatgaagctggaaaccatcattctcagcaaactaacacaggaacagaaaaccaaacaccacacatgttctcactcataaatgggagttgaacaatgagaacacatggacctggggaggggaacatcacacactggggcctttcaggggttgggggaaaaagggagggagagcatgaggacaaatacctaatgcatgcagggcttaaaacctagatgatgggttgataggtgcagcaaaccaccatggcacatgtctacctatgaaacaaacctgcactttctgcacatgtatcccagaacttaaagtaagatttaaaaaaaaaaacaaaacaaagcaaaacaaatatacataaacatagatacacacttaatacaatcaggtaggcatatactgagtgatttttaatgtaaattaaatcacatcaatatttgtttaaaatcctccaatagcctctcttttgaattgaaataagtcagaactctttacctagatgtacaaagtccaatacaatttagctcctaaccacctctttgacctcaatccctaatgctttccataactcactctagggcagctcctttggcttcatttgtgcttctttctgcctaatagagattttctgatggctgaccccttcctgtcattaggtatcaactcaaacatcaccttcccagggaggcctccatttactacacagtctagtctgtcatccatttcttttccccagcactgtttccatcacctttaaaagcttttgtatgtataaggacaaaacactgctgaaagaaattatagatgacataaccaaatggaaaaccattccatgttcatggattgaaagaatcaacatcttaaaatctctatactgcgttttttccccaacagggttgattagaggcttttagcacgcctcagtaacttggaagtagcataaaaatagtgcataaaaatcaactctggggactttaattcaagaaggaaaatgggaatcctcagcattcgtgaaggacacccaagatccctgggaggagaatgctggccaacagcttccatgacagcatctggctgacaaaaatgagtgaagccccagtatgtgagagaggcagagaacttcccactgtaactcatctttccactgaggattggagcaaccccaactgagaaagagcactttgtttctcccaagccttggaaataacttgggaaggggcttagagacattgtgagcgcaagacaccaggaaatactgcagacattttcccagacccaggactgagagcaggattctgtttttaattcgagtgcatactaagtcaagcttttctttgtgactcagcagcatagccatgcaggcattttagtctcaggccggagattggaatggctgctctggaacaggctaggaatctccataaccagagctgtgaaaagcacctcagtagtcggcactggaattgtactctaccctgtcacaaccctgtggtagaaggagagctgctacagctgcagtttctcctgggtgatgatacttgcagacagggctggcttggtgacctgctgtgtgtgtgccattgttgggtgctccagcctgctcccctgagttcatggtgcagcaggaccctctctgcctcatacccaggcagaaattcaggcattcagagcacaccctcacatggacccacagcctgagccaccccacccttcatgagtatagatcatgatgcatcaggaccctctccacaccatgcccaggcagatttccaggtattcagagcaccccctcactcacctgaatcagcagcctgagccaccctacccttcctgtgcatagacttagatacagtggggccctctctattcctaatgtggccagacctccaggcatttagagcaccgattcacatgaaacagcagcctgagacaccctagtcttcctgcgcatagatctgggtacaggaggctctctctgcttcacacccaggcagatctccaggcattcacctggttcagcagcctgaaccttcccacccttcctgggcatagattgtggtgcagcacggctctctctactcacgtccaggcaggtctccagacataaaggatacctgctcaccgagatcagcagactgacatgttctgtgcttcctgtgcacagatcctggtgcaggaggccctctgcttcatgcccaggcagatttctaggcattctgagaacctattctcctagattaggagtttaggctgccctcatccccctgcagagaacttggggctgaggaggtttcccaactccacacctaggcccatttctgggtgcttggaggccacccactggattcttgcttggcactggtacctgtgcctgccattggaggacctgttggcagacctgcctgttccagtaccatctatcttacccctctagagctgaggagggagctcagaccactgtgcactccacacattcacccattgcctaagacaaaagagagcttctcccagtaaacagggatcaagtatacacccagctacggtggcctcagctggctgttacctataagcgccatctactggcttgtaggttgaactgcacagcccaatataaaccctgccaacagaagagcacagggctgtagaagcaaagccaaaacaccctacccagtattctctacagtcacaccccttagggagatgggaaagggaaaaggacattttgaaaataatattacagagaaaaaaagaagagaaaatcctagatgcatgagaataattacaaaaatttgaagtgccagcatctccagatgagaaagattctggcaccatgaaaaatctgaatgtagtgacaccaccaaaggatcacactagctctccagcaatggtccctagccaaaatggaaactcaaaagtgacagataaagaatttaaagcattgattgcaaagaagctcaacaaaatccaaaacaaagttgaaaatcaacacaaataaacttctaaagcaatccaaaaaatggaggaatagataaacatctttaaaagaaatcaatcagagcatttggaattgagaaatttgaaattgaaaggaattgaaatactttcaagagaaaatttcaaaatacaattgaaagcttcaccaattgactcgaccaagctgaagaaagaatttcagagcctgaagactggtcttttgcactaacccagttagacaaaaacaaagaaaagagaattttaaaaaatgaacaaagtcttcaagaaagataagattatgtaaagtgaccaaacccatgaattattggcattgatgagagagaaagagaaaaagtaaacaatgtgaaaacatatttaagggaataactcaagaaaattaccctaatcttgctagagaggtagacatctggatagaagaaacccagagaacacctgcaagatactatacaaaatgaacatcatcaaggcatatagtcaccagcctgtccaaagtcaacactaaagaaaaaatcttaaaggcaaatagtcagatcacatacaaagggaaccccatcaagctaacatagacatttcagttgaaaccttacaagccagtagagatacaggcctattttcaacattcttaaagaaaagaaattccaaccaagaatttaatatcctgccatactaagcttcataagcaaaaaagaaataaaacctcttccagacaagcaagcactaatggaatttattaccactagaccaaccttacaagacatccttaaggaagttctaaacatggaaatgaaagaacaatacctgctaccacaaaagcacactaaggtacatagcctttagaccctaaaaagcaagcacacaatagaaactacaaagcaaccagctaattatttcacaataagatccaaacctcacataccaatattagtattgaatatatattgtctaaataccccccacttaaaatcacagagaggcaaattggaaaaaaaaaaaaaaaacaagacccatctgtctgctatcttcaagagagacatcttacacataacaccacccataagctcaaggtaaagggttagagaaagatctaccatgcaaacagaaaatgaaaaagagcaagggtcactgtctttatatcaaataaaaaagactttaaaccaacaacagtagaaaaggagaaagaagggcattacatagtgataaagggttcaattcatgagaagacttaactatcctagatatatacacacccaacattgaagcatctggattcataaaacaagtatttctagagctacaaaaagacttagacagccacacaatgaaaatagtggaggacttcaatatcccactgacagcattagacagatcattgaggcagaaaacaaagaaattctggacttcaatttgacacttgactaattggatctaatatgcttctaaagaatactccacccatgaaccacagaatatacattctacctgtctacacatggaacttactccaagatcaaccacatgcttgaccagaaggcaaatatcaataaaaacaaaaatttgaaatcataccaaccatacccatggaccagagtggaacaaaaataaaaattattataatgatctcttaaaaccacacaattacatgaaaattaaataactttctgctgaattacttttgggtaaataacaaaaagcagaaatcaaaaaattttcctgaaataaaaacagacacaacataccaaaatctctgggatgcagcaaaagcactgttagtaggaaagtttatagcactaattgcctacttcaaaaagttaaaaagatctcaaattaacaatgtaatatcacaccaagaggaactacaaaacaagaacaagctaacctcaaaggtagcagaaaacaagaaataactaaaatcagaacagaatgaaataaaagtgagaccccaaaagtcataaaaataatcaatgaaaccaaaaattgtttttgtaaaggataaaggataaaaaaatcaatatactgctaaacagattaacaaaaacaaagagaagaacacaatgagaaatgacaaaggtgacatacaactgatcccacagaaatacaaaagatcctcagagactgttatgaacagttatgtgcatacaggtgtatgcacataaactagaaaatctagaggaaactgacaaattcctagaaacacacaacctcccaaaattgaatcaggaagaaactgaaaccctaaacagaacaatatgaagttccaaaactgaatcagtaagaaaaaacttacccaccaaaaaagccctggaccaggtggattcacacctaaattctaccagacatgcaaggaagagccagtaccaattctactgaaactattccaaaaactcaaaaaggaacactgctgcctatctctttctatgaaaccagtatcaccatgataccaaaacctgtcaaagacacaacaataacataaaagtaaaaactacaggccaatatccttgccaaacatagatgtaaaaatgctcaacaaaatactagcaaactgaattcacctgcacatcaaaaagcattttaccatgatcacacagacttcattcctgggatgcaaagttggctcaatatatataaatcaataattgtaattcaccacacaaacagaattaaagacaaaaaccatatggtcatctcaatagatgcagaaaaagcattcaataaaatctaacatctcttcatgattaaaaaaaaatccatcaaaaaactaggcatcaaaggaagctaccttaaaataatgagtcatctataacaaacccacagctaacatcattctgaacagggaaaaaattgaagcattttccttgagaactggaatcatacaataatggtcactctcaccacccctattcaacatagtactggatgacctagccagagaaatcaggcaagagaaagatacaaagggcacccaaataggaaaagaagtcaaactctcttcttactgacgatatgatcctatacctagaataccctaaagactctgccaataggctcatggaactgataaacggctgacaaagtttcagaatatgaaattaacatataaaacttactagcatttctataaaccaataacatttggctcttatctgagagccatatcaagaatgaaaccccttttacaatggtcaccaaaaaataaaatacctaggaatacatctaaccaaggaggtgaaagatctctattaggaaaactataaaacactgcctaaagaaatcatagatgacacaaacaaatggaaaaacattccacgctcatggattggaagaatcaatatcattaaaatgtccatactgcccaaagcaatctacattttcaacgtgatttctaccaaactaccaacattatttttcacagaactagaaaaaaactactctaaaattcacatggaaccaaaaatgaggctgaatagccaaagcaatcctaagaaaaaagaacaaagttggatacatcttattacccaacgttgaactatgctataaggctatagtaaccaaaacagcatggtactcttacaaaaatagacatataaaccaagggaacagaatacagaaccctgaaataaagccacacatctacagtcatctgattcttgacaaatcaacaaaaataagcaagggtgaaagctcctcttattcaataaatggtgctggaaaaattggctagccatgtgcaaaagattaaaactggaaccctacttttcaccataaaacaaattaacccaaaatggattaaagacttaaacgtaagacctctaattgtcaaaatcctagaagaaaagctgggaaactactttttagacatcagccttgacaaagagtttatggcaatatcctcaaaagcaattgcaacaaaaacaaaagttgacaattgagacctaattaaagagcttctgcagggcaaaagaaaactatcaacagagcgaacagacaacctacaaaatgggagaaaatattcacaaactatgcctctgacaaaggactaatatctagaatctataaggaacttaaatcaacaagcaaaaagcaaataaccccattaaaaagtgggcaaaggagatgaaaagacacttctcaaaggaatgcatacaagtagccaacaaacatgaaaacaaaaatgctcaacatcactaatcatcagagaaatgcaaatcaaaaccacaataaaatactaactcataccagtcagaatggctattgttagaaagtcaaaaaatagcagaagttgatgaggctgaggaataaagggaatgcttatacactgtatgaatgtaaactacttctgccactgtgggaaacagttgggagagttctcaaagaactaaaaatagagctaccattcaacccagcaatcccattattgggtatataccaaaaggaaaataaattgctcgaccaaaaagaaacctgcgctcatatgtttatcacagcactattcacaacactgaaaacatggaatcaacccaggtgcctatcaatggtaaatttgataaataaaatgtgatacatatataccatgggatactatgcagccataaaaaaaagaataaaatcatgtcctttgcagaaacatggatgcagctggaagtcattattctaagcaaattaatgcagaaacagaaaaccaaatgtcacctcttctcataaagcgggagttaaatcttgggtacacatgaacaaaaacatgggaacagcagacactggggagggaaggagagaggtgggtaaaggctgaaaaacttcctactggttgctatgtttactatatgggtgataggatcaatcatatcccaaacctcaatttcacacaatatattcttgtagcaaatctgcacatgtaccccgactctaaaataaaaatagaaattttaaaaaaactgtacatagcacctatcattatcaagtctccttgcttatttctttacttgccattgtttgtctccactcctagaatgcaaaatttatatcactgcatccttcttacttaaaacagtgtctgatacatagcaagagaacaataaataaacattaaaggaatagcaactgaagaaagacagtgataagaatagtagttgtccatgatacaaatgttggttttaggattctctttaaaaacatacatagctgatttccagtcttaccaacttcatgataacaatgcagctggtgtaacttaatatatgcaaataaatataaatacttctggaaaaagtcaagaagtaaagaaaacgttcacaggagaggatgagaatatagaggttttgcttatcacagagagtagtaagaaaagaaatggaaattgagtccaatgagagtaataaaagggtaatgatagtagagaattggtttctagtggtggctgaggtataataggattagtccagaaagtctccttgtggaacatgggcacttggttctatgctttggtctgccacacatcaggcatcttcttagatagccccccaaggaatggctgaaactagggcatctgtgatcatcaactaaaagatacctaaatctttctatgaggtgtatgagactgctatattgactatatggtgatctgttttcttctatatcaaaatgaaatgctctaacctgagaaaaacaggttacatgaagaactaaaacatatagtttttagttttctgggctaaatatatgttgcaaaaatacaaaaccatttaagagcaaattacaaatttaattatcacaaaacaaccagcccctaaaatatcaccttttcaatatattttaagtagccagcggtccaccattgccatgaaaaatggtacatcaaaggtatttaacatgctgtaatttattctccacttccaggtgacaatgacaaattgctcaagttccctccttgttctttgcatcatcactacatgtttgaaaaatcgatatatcacttgcaaccaaggattacaaatgcagcccacatcctttcactttcttttttctttccccatctatcagagcatttccctctaatcattgcttacctgttctttcctctccatctttacttgttctctccctgagaccatattccatcttcttcatgaccaccccaatcttttacctcacactcaacaaagcaattctttacccacctttataataggtcaagctgctagccatgaggaggccacagggcctgactggcatacattggggcgaatggaaaaccatcctgggaatctagggtttggtaaggagcaagatatcaggaaagaggcatatgagaaagaagaccatggacagggcctgagcagcactagaccgcagggtcaatcagagaggtcaggtgtattatgatccgaaggcacataaacacaccagaaataaagaacaaggttggtgatgtctttcatctttctatgattgtttctcccttctattataaaatatgcactggccattcaaaggatataataaaataatagacaccactttcccttttctctcacaaattcccttataatccctgataattttacatgctttcagaatgttagcgcctgataagtaaaacaaaatttcagtttggccacagactcaaagcaagaaataggactccttgaagttgatttgaaataaatatagctatatttttgctgctatagcaactataaaatagaactatttattgacatatgcagaaaacaacataacattttattaatacacaattgagatgttctttacctttttatgtttacttattaatgggttattagtcattattagaacatttacatgatagagtagtaattaaaacaaaaagagaaattgaatgcatcctttagctataataaaggctaatgtttattatgtgccaggttttctgttaggcacttgacaattatcagttcatttaatcctcacaaagcaatgtagtattggaattatcctcattttacagatggggaaatggagggcgattcagagaaattgagcatattgttaataagtgatacagtcagaattagtacccagactgccaaacaactcacatttgccaaaaagcaaagatgctttttacactattccagcatatctccctacaatgacaccaaaggaaacttcagaattcaacaaacatagcctgagggcctgcggcatgcaatgcacacagcagagtgtgctggagatcataaacatttgtcagaaacaaatgttatcatctaaaagaagagataaaacatgtatataaacagctataataaaaggcagaaagccacagttatcaaaaagaaattctttgcatgttaagagaaagggggttatttctggtggagaggattaaataagactttaggaaggaaatggaccttaaagtttataaaattaatagttttgcaccaactacttgctcactgacattaggaagaagtacccatctcgcattccacaaagaacgtacagtcatgtatcatttaaggatgaggatacattttgagaaatgtggcattaggtgatttcatcgttgtatcagcatcactgagtacacttacacaaacctaaatggtacagcctactacacacctaggttatggtatggcctattgctcctaggctacaaacctgcacagaatgttactacactgaatactgtagacgattgtctacagtattaaccatttgcatgtctaaacaggggaaaggtgcagtaaaaatacatcattataatcttatgagcccaccatcatatacacagcacttcattgactgaaaggtaattaggcagttcctgaccacgtctcatttagaaattagtttctaaaaatccagagtggttctacaccaatcctaatctggtttctgtttctaagaaatgtgtttaagttaaacatctaaaaaaaatttctgtgaaattttgagctttgagcttaaaagtctgaaaacttacactctggattctggttacatgtgaaaaatactttttaaattattgtccacagcattgttgccttttttctaagctttcgtttttctgtacaggataaaacattttctcatctgaaaatatttccaaatagacccttattgccttaatctgttttgtgttgctattagtataacagaatacttcagactgggtaatttattcaaaaattagagatttatttggctcacagttctggaggatgggacatccaaagtcaaggggtcccaatcttgtgagggccttcttgctgtgttatcccatggtggaaagcatcacaatggtgagagagcaagagcagagggagccaaacttactttgtatcaggaatccattcctgcaataatagcattaatccattcatgagggcagagcccttgtaacctaatcacctcttaatggtcccacctcttaatacttaatgggtaggacattcaaatattagtacatattaatgtggatcttattatcagtattaggattctaatttatttattttgtagacctgaggtcagccaacttcaacaaaaatccatcctaccacttgcttttatgagatcttattgaaacacagctatgtccgttcattttcatattatctatggctcatgatacaatagcagaactaagcaatgtgacagaggccatatagcactcaaaacccaaaatagttaccatctaaccttttacagagttgcagacctttgccatagaccatccattcactcagcaagtatttattaagagcttataagggcaggtggctggtaggtagctagcataggttgttggctgaaaaactgtagcctcattaaactaagttaaaagttaattcatactgaattgtattcttcaatataattatcttcacatacgagaaaaaaacttgaacaacttttcctgtggaaaaaaatgtactaagtgacttggaatgtaatattactaggaggtactctactattactacttacactattgagtaacacttattgagcatttactgtgtgctcaacactattataaacacttaatataaatagtatatgtcattattcctcactacacctctaggatgtaagtgctgttactatcctcactttacaaatggtgaaattaagactcaaaccaattaatttctgaggtcacacagcttatatttgttaaagctgggactttatagaagatgctttcattcttggagatattaaaataagagagtggataacttattaaaaaggtaaaatggtgtacctttttaaggggagcaaaatataaataactaccatttactgagagcctactatagttctgtcattatgctatgtgctttaaaaacattctctaatttttatatcaacccttcaaggtaggtataagttccctcttttacaagcaatgaaaaaataataggttatatgactgacaaaaggtacataccttgtaagttgcaaaactaaggttaaaatttagatctacctgtcttgttctagaatacatgctaaattctattttttaaaaaatcctaggtgtatttttctaattcttgaaactgaactgcacttacaaatgaaagcaacagatgttcagcagctgaacaatgaaatatcagataggacaaataatgaaaatataacctacacaactaaaatagcagagaaaaatatagaaatatgaagcatatttctatatgtaaatacagaatttgttcctaatggtagccaggattcaaatcagaataagctacaatagaaatttctgaaggcactaaaataatctgaaatctcattaattcattctctaataaagcactgatgcattgacacttagcagatatctctgttgtaatcagttatccccgtttccatgggagaaggggactggtcaacccatttccatatttttgctgaagaaacatctaaagatgtgaacaatacccttctcttagatatgattgaataataaagaaaaaaaaagaggggactctgggctttaggaccaaagagaaataagttggtatattcacctctgctgcttcataactgtgtcaccacaacaagctaattgacttctctgtaactgagttttctcatttaaaaggatgtttatgagagatgctgtagaaaagcatcaggcatgccctcttaaaacacatctaagggaattattattctttcagttgtaatcacttttctcaaggaagatctttaagagaaaatattttctcacttattccctttcctagtggggagtaacaggagcaagactcactgtgtgatgccccgcgttgccttgggactctacagcacgtccttaccagcaagaaggctctcaccagctctggccccttgacctttgatatgtttggctgtctctccacccaaatctcatcttgaattgtagttcctacaattcccatgtgtcatgggagggacccagtgggaggtaattgaatcatgggagcgggtctttcccatgcttttctcatgatagtgaataagtctcaagagagctgatggctttataaaggggagttctcctgtacatgctctcttgcctcatgtctcatgtaagacatgactttgctcctcattcgccctccaccttgattgtgaggcctccccagccatgtggaactatgagtcaattaaacctctctcctttataaattacccagtctcgggtatgtctttattagcagtgagggaacaaacttatccaatcttggacttctcagcctccagaaccataaaatacaaatttattttctttataaattccccagtttcaggtattctgttataagtaacagaaaatgaattaatacagaaaattgttaccgagaagtggagtgttgctgataatgaataactaaaattgtggaagcagctttggaactagataatgggcagaagctggaagaatttggaggagcaggctagaaaaagcctagattctggtgagggtttagaagacaagacaactagggaaagtttggaagtccttagagattggttaagtagtcatgaccagagtgctgatagaaatatgcacagtaaaggccatttcgatgaggtttcaaatgtaactgaggaacaagggagtggaaaccagagcaaaggtcattcttgtcataaatgggcaaagaacttggctgaactatgttaatgctgagggctttggggaaggcaaaaatcaacagtgatgaactagagtatgtggcagaagaaatttctaagtaaaacataaaagttgctgcatggttacttttggctgcttacactgagaattgaaagcaaataataacttaaagaaagaatttataatcaagagagaaggagaattgaaagatttggaaaatgctcagcctaaccacataaagaatgaaaaaatgtgttcaggagaggaaaccaagggtgtagcccagtgaccacttgcaaaagagattactacacacaaaagggagccaggtgctattcctcaagaaaatggaagaaagacccagaaagcatttcagaaatcttcaaggctctcccatcacaggctcaaaggctgaggagagtagagtggtttcacgggacaggcctggggtgctcattgcccaggtccaacttgtgactttgctccccacacccttgcatggtgctccatggttgccccagccatggcttaagtggtcccaggtgcagatcatgccacagttcctgatggtacaagtcataaactatagcaacatccatataatgttaattctgtaggcttgcagaaaacaagagctgtggaggcttggcagcctccacccagatttcaaagaatgtcatcaaaagcctggggtctcaggcacagacttgttacaggaaaggagtgaccacagacagcccctgctagagcaagaaaaagtggaaatgtggggttggagctgctgcagagaatcctcactgcatagggcagtacctagtggagccataggagcaaaaccaccaccaaaatgccagaactatacagctgccagcatgcaatcctagtcgaggagagctgaagcatgagctaagcccaggaaagccacaaaggcagggtttttcaaggccttggggacttaacccccacatcagtttgtgcagaatgctagtcatggagtcaaaggagattattcctcacccttagatttaatgtctgccctcttgggtttcagacttgtttggggcctgttactcctttcttttggcctgtgtcttccttttctttctatatatatatatatatatatatatatatatatatatatattttaattatactttaagttctagggtacatgtgcacaatgtgcaggtttgttacatatgtatacatgtgccatgttggtgtcctgcacccagtaactcgtcatttacatcaggtatatctcctaatgctatccctcccccctccccccaccccaccacaggccccagtgtgtgatgttccccttcctgtgtccaagtgttctcattgttcaacttccacctatgagtgagaacatgccatgtttggtttttgtccttgcaatagtttgctgagaatgatggtttccagcttcatccatgtccctacaaaggacatgaactcatcattttttatgtctgcatagtattccatggtgtatatgtgccacattttcttaatccagtctatcattgttggacatttgggttggttccaagtctttgctattgtgaatagtgccgcaataaacatacgtgtgcatgtgtctgtactacaaggctacagtaactaaaacagcatggtactggtaccaaaacagagatacagaccaacggaacagaacagagccctcagaaataataccacacatctacaactatctgatctttgacaagcctgacaaaaacaagaaatggggaaaggattccctatttaataaatggtgctgggaaaactggctagccatatatagaaagctgaaactggatcccttccttacaccttatacaaaaattaattcgagatggattaaagacttaaatgttagacctaaaaccataaaaatcctagaagaaaacctaggcaataccattcaggacataggcatgggcaaggacttcatgtctaaaacaccaaaagcaatggcaataaaagccaaaattgacaaatgggatctaattaaactaaagagcttctgcacagcaaaagaaactaccatcagagtgaacaggcaacctaaagaatgggagaaaaattttgcaatctactcatctgacaaagggctaatatctagaatctacaaagaactcaaacaaatttacaagaaaaaaacaaccccatcaacaagtgggcgaaggatatgaacagacacttctcaaaagaagacatttatgaagccaacagacactgtgtcttccttttctaatggaaatgtctaccatatgcctgtataacaccactgtatcttgaatgtaggtagcttgttttgatatcatgagactatgaattttggacatttgggttggtgctggaacaagttaagaatttggggctatgatgtggaagaaatggatttttatgtgagaaggacatcagttttggagggccagaagcaatatactatggtttgaatattttcccatttcaaaactcatgttgaaatttaatctccaatgtggcagtattgagagaagaggcatttaagaggtgttgggtcatgagaacagagccctcatgaatggattaatacattcatcaattaatagatgaatgagttaatggattaatgggctatcatgggagtgggactggtggctttataagaagaggaagagagacctgagagagcacattcagccccctcaccatgtgaggccctgcaccaccttgggtctctacagagttctcagaaggctctcaccagatgtagccccttgaccttggacttctcaacctcagaactataaaaaatatattacttttctttataaattacccagtttcaagtgttctgatataaacaacagaaaataggctaatatatctatttaatgcataaaaagagacttgaaaacagaaatttataccatgtccctgagtaaaatattaaatgttgtaaaatgctaattttatcctaaataatctctaaatttgctattcttccaatcaaaatctcaacaggtaaaatctaaaactgtaaaactcttagaagaaagcagaaaagctttatgacattggatttggcaatgattgctgggttataataacactaaaagcacaagcaacaaaagtaaaaattagataaattggactacatcaacctttaaaactgtgcgtcaaggggacacaatcaacagagtaaaaaggcaatctatgaaatgggagaaaatactcttaaatcacgtatataaagtgattaatatccagaatatataagaaactcctacaactcaacaaaataacccagttaaaaaatagaaaaaagacttgaatagacacttttccagagaagatatacaaatggtcaacaagcacatgaaaagatgcccaacatcactaatcattagggaaatgcaaatcaaaaccacaaagagatgttacttcacaaccatcaggatggctactatcaaaaaagctaagtaagtgttggctaggatgtgaagaaattggaatccttgtgtatcattggtggaaatttaaaatgatgcagccactatggaaaacagcactgcagttcctcttaaaattagaaatagaattaccataagatccagcaactttactgcttggtatgcatccaaaagaattaaaaacagaatcaaagagatatttccaaacccatattatagaagcatttttcacaacagccaaaaggtggaggcaacctaagtgttcactgacaaatgaatggatcaacaaaatatggtatatacacacaatggaatattattcagccttaaaaagaaaaatcgtgtcatatgccacaacatagatgaatcttgagaacattatgctaagtgaaataagccagtcacaaaaagataaatattgtatgattccacttagttgaggtatctagagtagtcaaattcctagaaataaaaagtagaatggtggttgccattgacagatagggggaggaataaatagaaagttttgtttaatgggtacagagtttcagatttccataataaaaaaactttggagactgattagacaataacatgaatacaattaccactattgaactgtacactttaaaaatagttaatatggaaaattctatgttacgtgtatcttcacaattttttttaaagttcagtagggtaattatgcaaatgtaacatttaaaatcaatagaggaagctggattattcgataaatgatgctaggacaactgatcattaatttgggggtaggaaggaaccatagataaattataaatctgaaaataaataaaactatacgaagaaaataaggtaaaatattttataattgtggggctggtcaaggtcagcctaagcaagatacaaaatccagaagctttaagtaaatacacagatagaacacttcataaaaattaaaacttttacaccacaaaaaaaagataaataccaagaaacaggctggaaaaatacttttaaaatatttttaacagacaaagtctgttaaatatatttgatctagaatatacagtctagaatatagaattctgtttggtctagaatatacagtcaattcttgctttcacagtaattttattcaataaagccaccatgaacaccaagttagtaaatactaaatcattgctcctaagagaatgcaggtttagattcctggagcctctggtcacaatatttttatcaactgatcaatacaaaatcttgttttgtatatgcttctgtttaaagacaacttatttaacatatattgttgatttattaacattgaactcacagccatgagttccacaatataactcatacctcagtgaagcttatctgacacatagattttctccataagctacatcactagtgtttcttatgcctctagaaacactagaaagtacttcagcactacactggaggccattttaaacagtgaaatgcccaaggaaaaccagaaaattttttttaaaaaactggcactaaatagaatatgaaaaggacacttgtttcttgtttacagtatgagaactgaaacaagaaggcagagtgttgtcttgttcaacctcaactgggactcaactgggaacatgtgcaattttccactgctctgtgcacgtccatgaatgagaagaaccatgaaaacaaagaaccatttatgattacaaattttagcaaataagtgaatttccaaatatggcatccactagtaataagaatttaatgttttaaaatacacttcaaaatcaattctttgaaaaatataagaagtaaaaataatttgattcacatgagaaaaaatacaattgcctcaaaaatctaaagggaaacaaaagttccttctcactaataatcaggaaaatgtgacttcagtcaacagtgatgatgatggccgggtgtggtggctcacacctgtaatccttgcactttgggaggccaaggtgggtggatcatttgaggtcaggagttcaagatcagcctgaccaacatagtgaaaccctgtctctactaaaaatacaaaaaagaaaattagctgggcatgttggcacatgcctgtagtcccagctactcaggaggctgaggcaggagaatcactttaacctgggaggcggagtttgccaagatcgtgccactgcactccagcttgggcagcaaagtgagactccatctcagaaaatagtaataataataattgatacctctgatatggtttggctgtgtccccacccaaatctcatattggattatagttcccataatccccatgtgtgatggttaatactgaatgtcaactcgattggattgaaggatgcaaagtattgatcctgggtgtgtctgtgagggtgttgccaaaggagattaacatttgagtcagtgagctgggaaaggcagacccacccttaatctgggcaggcgcaatctaatcagctgccagtgcagctaggataaaagcaggcagaagaacgtgaaaagaatatgctggcttagcctcccagcctacatttttctttcatgctggatgcttcctgccctcaaacatcagacttcaagttcttcagctttgggattcagactggattccttgctcctcagcttgcagcctattgtggggccttgtgatcatgtgagtttaacactccttaataaactcccctttctatatatatataatatatatataatatatatatacacacacatacacatacacggagagagagagagagacataaagagagaaaaaaagagagagagatcctgttagttctgtccctctagacaaccctaatacaccatgtgtcatgggagggacctggtgggaggtaattaaatcacggggatggttacccccatcctgcttttctctgacagtgagtgagttctcatgagatctgatggtttataagggtatttttccccctttgcttggcacttctttctcctgctgccatgtgaagaagaacatatttgtttccctttctgccacgaactaatatagtaaattggtaacacagagagtgggggactgctataaagacacacgaaaatgtgaaagcgactttggaactgggtaaccggcagaggttggaacagtttcgagggcccagaagacaggaaaatgtgggaaagtctgcaacttcctagagacttgagggctcagaagacaggaagatatggggaagtttggagcttcctagagacttgctgaatggctttggtcaaaatgttgatagtgatggacaatgaagtccaggctgaggtgtctcagatggagatgaggaacttgttgggaactgcaataaaggtgattcttgctatgctttagcaaagagactggtagcattttgctcctgtcctagagatttgtagaactttgaatgtgagagagatgatttagggtatctggtggaagaaatttctaagcagcaaagcattcaagaggaaagagagcataaaagtttagaatatttgcagcctgacaatgtggtagaagagaaaaacccattttctggggagaaatcaagtgactgcagaaattcacataagtcacaaggaaccaaatgttaatcaccaagacaatggggaaaatgtcttcagggcatgtcagagacattcacagcagcccctccaatcacaggtcctgagacctaggagggaaaatacggtttcctgagctgggtccagggtcccccgtgctgcctcacaacttggcgccctgcatcccagccactccagccctggtctaaaaggtgccaaggtacagctcgggccatatcttcagagggtgcaagccccaagccttggtggcttccatgtggtgttggtcctgcaggtccaacagaagacaagaattgaggtttgggaacctttgcctagatttcagaggatgcatggaaatgcctggatgtccaggcagaagtttgctctaggggcagagtcctcatggagaacctctgatagggcagtgtgaaagggaaatgtggggttggagcccccaaacagagtccccactgggggactacctagtagagattgttttagaacttaaaggtttaatgactaccctattggatttcagacttgcacggggcctgtagcccctttgttttggccaatttctcccttttgaaacaggtgtatttacccagtatctgtatccccattgtatacaggaagtaactaacttgcttttgattttacaggctcataagcagaagaaacttgccttgtctcaggtaagactttggactgtggacttttgagtaaatgctgaaatgagttaagactttgggggactgctggaaaggcataattgatttgaaatgtgagaacatgatatttgggaggtaccaggggtggaatgatatggtttgcttgtgtccccaccaaaatctcatcgtggattttagttcccacaacccccacgtcatgggagggacccagttggaggcaattggatcagggacagttacccccatcctgctgttctcataatagtgaatgagttctcacgagatctgatggttttaaaaggggcatttccccctttgctcggcacttctttctcctgccgccatatgaaggatgtgtttgcttcccttcaatcttgattgtaagtttcctgaggcatccccagcccagcagagctgtgagtcaattgaacctctttcctttataaattacccagtcttgggcagttcttcatagcagagtgataacttactagaacaacctcttaacaaaaatggtcagataggctgggcatggtggctcacatctgtaatcccagcactttggtaggccaaggtgggcggactacctgaggtcagcagttcaagaccagcctggccaacacagtgaaaccccatctctactgaaaatacaaaaattagccaggagtggtggtgagcacctatcatcccagctacttgggaggccgaggcaggcgaattacttgaacccgggaggcagaggttgcagtgagccaagattgtgccactgcactccagcctgggtgagagagcaaaactccatctcaaaataaataaataacttaattaattaaaataaaataaaattagacaaaaacgatcatacaaacaattcatcccacactgtcttcagctgtccgtacttcatcctccttgtagagcaattttgatgattcaagacaagtgaatcaaaaatacctaaaatgatgttgctatggtttgagtgtccccccacaaaactcattttgaaatttaactgctattttaataatattaaaaggtgagactattaaaagataattagaccatgaggactttgccctcatgaatggataaatgtcattattcttggagtgtgtttgctatgaaaggatgagttcaaccgtctctcattctcttgacctctcttaccctctcaccttctgccttgggatgatgtaggaagaaagcccttgacagatgccagcaccctgatattagacttcccagccttcgaaactgtgagaagtaaatttcttttctttataaattatccagtcggtggtattctgttacagcagcacaaaatggactaagacaggtatggattgaaatgaaaaatgaacggatgagtgggtaggtagatggatggatgaatggatcaatggataaattggttgaatgagtaatgaatggacagatgcaagcaataacttgcaaactattctacaggaactcatggtgccataaggagtcattacgactttttacaacttatggcatttattttttcagaaaatataaaatctttattagaaaaattagatctgcttgtcataaataattcaaacaatgtttaagtatataaagcaggaagttaaagtctcccttgaatcttaagccttagaaataaccactatagctgtatactatacatacttccagattttctgagcacatacaaattaacattgcacatattagaatgcacttattatatgaagttgttttatactatacatactgccaatcctaccaaaactgacagagtgatgtctctgaaggccacaaacaaaacaatttttaaaaatgtgcgtttgtattgtaaataatttatagagaatcttgcatttatattgaaagagcttcataacaatcctacaaacaaacaggaactagcgtcctcattttaaagaagcagcagcagagggtgagttacttgcccaagattttatggccaacaaataatagtcaggccaattactttaactaaattataaagtttctcagagcagaaaccacacataattccagttttgtatcatttacagtacctggcacaaaattataaacaggtatgaggagggtatgatgtttatattgcttactgctctatgccacacatataacaaatggtcaataaacatctgtgaaacaaatggatggaaagatgtataaaagaagaggaaatgggaagagattctaaatgaactaagatacttatcaaaccatcattttttcaatttggacaataataaatacgtttagcagctcatccactccgtaagcataatacaacatgataaccaatatcattgatatcaatatcaaaatgatatcaattgaatatactctagataagagtgacatcaacaattactgatttcctctttaacagtgaaatgccatagtaaaaaatattgaacagtagacactatacacccttattgttgctaaaagaagctattccgtctatttttttaattttatatcaaatattcacatggaatttggctcaaacacaatagatatgcaaactataaaagtataaatagtccatagggactatgggaaagtataaatagtccatagaattactgtgaaatataagtgagacaaggaacgttaagtgcttatcactgcacttggaatgtggtaggtactcaataagtgttagatatcattattaacatcactattaacatcatcatcataaggctttcctaaaatgattaaaaaattgaggctttccaaaggcaaaattatagttcatttattttaaaagttataaaaataactgcacaaaacaataaaaatctagatcacacaaatgcttgacaggaaagctgaaatgcatttttctgtaaaataaatatatgtcccatcttctgcctagatgcagactacaggcatattctccttgagtgcatctatgagagatgaaatgtctactgacctaatttctgtagctattgtatctgtttcttacagccactgtaacaaaccgccacaaacttagtattatagcttaaaataacaaaatatgttttctgacagttattgggatcaaaagtttaaaagacatttcacagggctaaaattaaggtgttagcagggctggttacttctggaggctctaaaagagaatctagggggcatggtggcttatgtctgtaattccagcactttgggaggccgaggcaggtgaatcacctgaggtcaggagttcaagacaagacaggccaacatggtgaaaccccatctctactaaaaatacaaaaaattagctgggcgtggtgatgcatgcctgtaatcccagctactcaggaggctgaggcaggagaactgcttgaacccaggaggcagaggttgcagtgagccaggatggcaacagagcaagacaacatctcaaataagtaaatttataaataaataaaaataaaagagaatctgttccctgcctttttcaacttcaaggggccacctgtattccttggctcatagcctcttcctccatcttcaaagctagcaatgtaacatcttcaaatctctgctttcctcatcatatcacactataagtaccttcataattacattgggcacacattgataatccaggataatccccccccatcataagatcctttagttaacaatatatgtcccttttgtcatatacagtaacatattcataggctctacatactagaatttagacatttggggaggagcattatgctgtctttatcacagtacatcctctggacaccaaataatcacattcttccacatataaaatccattcatgccatctcaacgtcccataaatcttaacccattacacaacatcaacttaaactcaaaatctcaaaaactcaaaagtcccaaatttcctcatataaatcaagcatgagtcagacgcatctgtgaatctgtgaaactggaataaaaagttattcgctcctaaaattcaatgatatgacaagtgtagcgaaacaattatagatatccccaaccaaagagagagaaatgaaaaataaaaagtgagtcaacagtccgaagcaattcagaactgcaactgggcaaactccattaggtttcaagccctgggaataatcctttggagttctcagctctaccctctcgggcctcagtcccatcctctgagtcctcctttctattccataaaggttaacttatgtttgcaaactcagtagtttcataagcctatttcctgcctgcagaatttcaggaatccaacagccttctttcattttatcctctgtccctttaagtccaagctaccaaagtctccgctaataaaccattcatgaaaacactgtgggtctcccaggtatgtcacaagaatttcctggataatcccaactctgaatcccatctcagcgtaattcatctcatcataattcagatctgctcaatctcttcaaagagccctctgtgtggttgaataatctcagtttttgatcctcctgaggcactagaaacaagttatctagccatgctttcagctttctctctaagtacacttcttgacagtgaatctaaaaatttcagtgttttttgcaatctggatagattgagaatgttccaaccatcaagtcctggtttctttgagtttaaatgttcttctcacaatttatctctttcctcctcccacatttcagtataggcaacaagaggaaaccaggccatacctccaacactttatctagaaatctactcagcaaaatatccaagttcatcacctactagatctgctttgcacataaccatagaatataattcctctagactatctgctattatatagcaagtatctcctttcctccagttttcaataacatgtttcctatttatttctgagtccttatcagaagcacctttaacattcatatgtttattaacattctctctacaatgatttaggtattctctaagatcatacaagttctctctaccatttcccccgctttcttctgaaccctcacagtagtgactttaacatcctcgtttgtataaacattatgtttatgacaattaggtaatctctaagaaaatacaggttttctctaccatatcacttctttctgagcccttattagcggcatctttaatgtccatatttctgttcaaggcaatctaagctctttacatcatgctcctcaaaattcttctagcttctacccagtgcccaattccaaagccatttctatatttttatgcacctgttacagcagcactccacttccaggtaccaaaatgtggaatagtttcctagggctaccattacaaattaccacaaacttagttgcttataacaacacaaatttattctctcatagttctcaaggtcaaagtctaaaatgattctctctgggctaaagttaaggtattggcagggctatctccttctggaggctcacagggagaatccacttcctgttttttcagcttccagaggcctcttgcattcctttggtccatggctgcaccactctgacctctacttccatcatcacatatcttctgactctgaccctgctgcctttctcttacaaagaccactgtgattacaccggacccccaacgtaatccagataacacccccaattcagatcctaaactgaatcacatctgcaaagttcctctgccacataaggtaatatattcacaggttgtgaagattataatgtaaatatcttttgggggaattattctgtaaaccacagccatgttcattattaactgatttctgtttaaaatacttaacccatattttcaattacatagttttaagcactaacaccgctgattgcctatcttactgaactaatatcttgccatttcctcatttcaaacgttggttcttttaaaagttttgggaagacgaaatttagcaagagaataaaatcatatattgaattaaacaattcccagagcagttatacgaataatatctcgattcattgttatggttcagagtatctccaaagtatgtagtagttttgttgttgggagagagggggaaagctaaagccctatcacaaaaccgtaactattctggagttgaaagatagctcaggggtcatctccatttcaaggctgagaaaaataaggcccagagaggttaaattattaacccaatgacataaactccaacagagaggagagagtatataaatttattttaatatatctagtgactaactatatagaaatctgatttaacagcaaccacacagaaagctgctgcattttcataaaaggaatttcttaatctcaagttcaggtagttttttatttagctatctgagcttctcaagtcttgaggcaaatgctaaaaaggtagttttctaaacagctagaggaatttcagacaaaccccatcaaattcataaaaataggtatttgccagaatgctacataggatggttatcaagccaaatgaaagaggttccaccgttgtcagtctactgactggtgtggaaaatccaaacatctataggctctataagtaatgtagtttctggcttccttggagaccagcgctctaatggaactctaagacaaatatcttgtcatatatgtgtatagcaaaaaagtacttttaagaaaatcagtaaaaaaaaaaaaaaaaggcacttaaattaaattttgctgtgtccaatactaccaatcctgttatcccttatgaaaaacatcagaaccacttggacacttttaaaacgttattttactaaatgtgtatttggtttcttggttttgccaattacaagataagtaacatagacttgaagtggaagttaagatataaagactttaggaagggcagtaaaaagtgctattgatatgtgaataggcatctcaataaataaaataaaaatactccaagtatccaaaataatcaaacatttcaatatgaaaggaagaaattatgtttgcattgacttatgcaactaaagactcaagtgggctgggcacggtggctcacacctgtaatcccagcacttggggggccaaggcgggcgaatcacgaggtcaggagttcgagaccagcctgagcaatatggtgaaaccccatctctactaaaaatacaaattagccgggcgtggtggcacacgcctgtagtcccagctactaggaaagctgatgcaggagaatcacttgaacccaggaggcggaggttgcagtgagccaagatcacgccactgattccagcccgggtgacagagtgagactccatctcaaaaaaaaaaaaaaaaaaaaaaaaaaagactcaactatggctatggctctgtgtgtgtgtgtgtgtttgtgttcacatgggttatcatgtgtactgtcatttcaataaagatattataatcttattgaattgaaaatatttgcaatacctagcaaaattctttacagcttttttttttctcaatacaatctgatggtaaagaatagagcataaatgtgatgtttaaggctcttttcattccatagccagggtatgaatgtctaggtaaaactcaaaaattgcatcaacagtttgagggtgagtcaaaacataaaatttatcatggctatagaaacagaaaaaaaaaaatacattgccaataaaatagttatttcccctggtaacagaaataaatttcctaataaaaatagaagttaaaaagaaaatgaaaattatacctaagcactttaaacatttcactgaacataattccatatccacaaacacatacacgtggtcttacataaattgaatctcacctatactatgagtttgaaatcagtttttctcttattctttaagaaaaaaaaaggtcagggatatcttttcatgtcaataaataggaaaactacgtaatcatttttagggctgcagactgtcccgtcacagaagctccataatttatttaagcaatcccctattgtaagacactaatgctgtttataattttttactctacaacaaacattgataaacatcctgtaccaatctgtttaccaatttatccaattctctctttaaaataaatgtctacaactagaggagctggataaatgagtatacagagaatgtatattaaactcttgccttgcacagaaaatttacctctaacccttttgaaagcaatttgccagaatgcattaaggtccctagatggtaggttggtggcggggtagtggtctgctgagctgtggagggcggtggggctgagggtggggtggagagggcggtgcccctgctctgaggcagggactactgggtgacagagacaaaggggtgtgtgatggggcaggtcacaatgggtaggggaggataaaagtggtcctgcggggtggtttagcagcagtggatggttcaggttgggaagaagagcagtgggattgccagttaaggttgtggaatcaaagagcaaaggctgttgtgaagtggaatatcaggctcaaatggaggtccctcccgaatgagcactgacacctgtgtgcccggacatccacgagggccccaacacctgtgctcctgacagctccatgcactaagcagggcacagtctggatccaggggactgactgtctctggcattgagcggttggtaatcaataccccaccctccctgttctcagtcacttggggacaaaaaagaaagcctgcagaacacgactgctggcccacctgccagagtagccaaggaaacaggatgcccgctaaagcatgttaaggaaggtgtggagcagctgctgggaactgtcttgatttaaaggaagacatggaggactgctgtatgctaccgtattacacggcccaaagcagccccgcaatgggcatgtttaacacctccatggggaagctgcagcggcaactgtacaaaggcgagtatactatattcaggtatgcacccatgtttgagagcgactttatccagatcagcaaaagaggagaagtgattgacgtgcacaaccgtgcccgaatggtaacaatgggcatcgttcgcaccagcccctgcctcacactacctgatgtcatgctgctggcccgaccagctgctgtctgtgacaatgccaggtgtggtcctgccacccagaaaagagaaagtccgcctgcagagatcttagaactaaccaggctgcttcccttgatgtttgtgaaaataaccatccacaacagcgtaaaaaaacagctccacctgaagcttgccacgggccgctctttttatcttcagctgtgtcctccatcggatgcaagtgaagacctttttgttcactgggaaaaccttgtttacatcctgagaccaccagtggaggcttacagtgataccagggctatcctagctgggaacacattggactcatctgtgttggaggaagtgcagaggagcccagtggtgagtctatgcagagactagatggggcctggatgctttgggggagagcaggtacaggtcctgtaaagcctttggtgctgcagctcacctgggaaatgcattgcatttggaaggtctgaaggccaaatgagcttccatttggaggccatggtacattgaggaggttcctagtgcttctccagggttctccaagcctgaatttcagagatttcttagctgtcagcaactcttcattttatatccacagctgttcattttatatcaatgttgtaatgctgtccaaagcatcctgaccagtctattctgaaacacatactatgacctaggcaggctgatatgttgtaggacgtgtctccctgcaattgccacttatatacattggtggcaacacaacatgtttgtgtacttgtgcaataatttctttttgttgtttacctataggaagagaaaggagatcttgctggtctcactgtctttgcttatttgttctctccctagggatatgccatgaagttttgtgaagagaaggagcaattcagaatcagtagacttcacatgaatgctgaaatgtttgggtccacctattgtgattatacaatagagatatgaatccaacatacctcccacatatactacgttcaagagttcacacacccctgcagtcataaaacctatagtgcctgatgaaggggcagggtagcaacagcagtagtgatgacagtaagcaccaccacaggtaccatggatgtggctgcaaccaagtctgcagactcaggagagaaacacagcactggcaaaagcagccttcagaggtccaggaggaagtatagccagcatggctattagtgggtgcttccatgtcttaatcttgttatagcaagggctgcatgcacattcttgtcctaaaagggtacttcaagcatatcagtaagtgctactggcctctccctagagagcagtatgaatgtggtggctacaggagcagagagatactgagaaggctgttgcattgacagtatctctctgctactcaaaggctgactctctgctactcagcattgggagtcagttatctcaactctgcaggatgaggccacatgcgtgaatgggatggaagccagagggtctctacctagctggattgactctgcagtaataacctcaaagcccagtactacacatggtgcagaggtggacatctcacctaagactgtggaggggaacaatgtgattcaccataataaaatccatcaactcaaattatctgctctaataacatatgctctattgacaggaagggtagcaataaaactaatggcaatttatgatcaggctctgaaaactatctttaactttcccttaactttatattttttaaataaattaatagatgacagaataaaatgttgaagattactctcagatatgatcctacattaggagaattattctaaaactgttttccaaaatataaaatgagaacccaggaatacacacacacagactctctctctctctcctctctctctccaggtttgaatcacagcattgccacacattaactgtgagtttcagtagattgtttctttaaatggtcaccttgagaccatacatgtataatatctggaacatagtaggcactgtgtaaatggtagtgttgagaaacaaattctgagtttaatcatactttccagaaagggcttaattttcccagtctcttcattcttgatttcctttcttaaatcttaattaactgctttgcaattgtcccataaaagctctatttacagtaaatcttctcagtatcttccaagaattttaatcccctgacgctatttagaattctaaattttcatgaatttgtagaaatttcaatctagttacaatggaaagataattgcaaagcactcatcttttacctggttctctccaattttagtattcttggagatagaaaaataaaatgtaatataggatcaattcataatctggacaaaaactggaaattagatcattttagaattgtaagatccacatccatgggattagccaatattctaattttgcaagtaaaaagtctgctcgagtctaaagtaatacatcacatggtttgagaaccagaatgtataggtaacctggcccccaattatgtctgtattgtttccataacactcatgattctgacaagcactgtgctttgaatataaaagatatttgatacatgtttgctggatccaattaagggctataaatgtgaaatataatttattccaatcaaacaaatctggggatataaaattttacatagtactgtactaattgtacagatcccaaaggcccctgtatatattgtaaggaagcagtttaccagtagaccctcacagcgcttacgacttaatgatttttaatggcctccaaaagtgcttcagacctgaaaaaaatggtttcaaaatatgaaaaacatttcacaggttagatgttctagctttgcgaatttcaaggttacattactgagaaatcacatctaaccataaatcacttttcagcaaataatttcaaatgaaaaaatttaaaaataaaacaatttttgtttttcatgtggtacgtagcccagtatcatatgatactggagaccccctaagaagctttaaaatgaccatattgcaaactcttaacagagaccaactttatctttatattcaaggactgtcagcatgcttaccacattgtagtcccttgataatcatagaagggatcattgttaaaagcactgcacattttgtattttttctctaaatcttaatctgactcaatctctttttaaattgtatattcctttggtaaatatttcaatctgcttctgattacaaatcctgatgcttattactatcagatcctgttcctaggtcacagttttcttaaaattctaaaacaatacatatcctgttacctcatctcttgtaatcaaagtttaagagataatttagataatagatactgataataacagaaaaagatttaaaaattaccatttgtgaatggttgagaatggttgaatcctaggtaataaactaaaaaaccagatgaattaaaaaatgttgcaaattgtgtatgtgtgtatgtgtatatactatatatatgtacaaatatactatatatacacaaaaatatgctatacatattatatttttaattgcaaaacttcaaaaattctttaatatattttgcaatgaaaatgtatatatataaacatgttatatatacataaaacatgtttacatgtgtatatatatatatacacacacatatacacacacaaatataaatgctaaaggatagcccttaaacaataatattcacagacacacacacacacacattcttaagaatttatagtgagaggctgggtgcagtggctcacgcctgtaataccagcactttgggaagccgaggcgggcagatcacttgaggccaggagtttgagatgagattggccaatattgtgaaatgccgtctctactaaaaacacaaaaattagccaagcatagtggcgcacccctgtaatcccagctactcaggaagctgaggcaggagaatcgcttgaaccagggaggcagaggttgcagtgatccaagatcgtaccactgcactccagcctgggaaacagagcgagactccatctgaaaaaaaaagaaaaatttatagtgagagaaacattagtaaaatagtcttattgctggtttgttagattaaattcagttaaaaaaaaacacccaaaacctgtatctcaagtacatttatagatttaatgcagtaaaaattaaaatcccaatagagatactttttaaactcaacatagtacttacaaaatacagattttataaagcaagcaatcaagtcagctgctagttttaatttaataatggataataccaacactgagtcatgtggtttaaaaaataggaaggcagaaataaacaagccttcagaagtaaaaccaaaacaaaaggataaaaacgagaggaatatgagttattgttcaatggaaagtcataggaaaactagatatcaacaagcaaaaaataatatagagccataattgaaatttatgttaaaaggagttctaaataagatgaattaaatgaaaaataggattgagaagcttaatcaactggatagtttttttaaattacatgatgcacttgtacacatacaaattaagacaaaaagaaaagctgcagactgggaaagattttgtggtaaatgtaactagaacatctgaggaattaataaacttattgaacaataccagtcttcaccaaggaaatggccaaaggtaaagcaaacctaatattaaaaattgtagaccaaaagcaaggtactaccaagcctaaaaaataataaaatcaaatttagaaaaaagcaaatgttagtaaggtggtagaaaatcagatacaatcatattactgacagctttttgatttgcagtcatctggctaatatagtaaataccctgattattttatttcagtaattatttttaagatataaggcaaagtaatgattaggaaatgtatttttacaaatgcagttttatgaggggaaaataggttaaaacatttaattattgataaactgctaagcagttaagggtaagctaataaaatacaacttatgcttgttaattttctttccctttacccatgtagatatgaggtaaaaaactatatgtaaaaactttaagtgaagacatgacaccctagaatatacacatttgttcactgagattcattcaactattacttcattccaattatttttttttgttttacatccatcagattttgcttgataaagaagacatttttttctcttcctttctttctttctttttttttttttttttttgagacagagtctcactctatcataacccaggctggaatgcagtggtatgatcacagctcaatgcagcctcaacctcccatctcagcctcctgagtagctagggctatgggtgtgtactaccacacctggcttatttttgtattttttgtagagacaaggtctcactatgttgcccaggctggtcttgaacttctgggctcaagcaatccaccctcctcggcctcccacagtgctgagattacaggtgtgagataccacatcgaacccattcttctgatttgccaggaactacgcgttagactgcagatgctgagcatcaaaaggttgaatctctacctttatggagctcacagtttagtatgtatttacaacaattctgtaaaggttacagtaaactgtcttaaagtcctatgaagagattttttaagtactatatactgatttgaatatcctacttagctttctacaacaaattaatattgaaatttgaggggctatgatcaaattatgatacagacatgtggaagacgtgatggtttcttagacataattgtttcgtatttgtcgtgacagaagggaaaatatctttgagatgtaacacttttctggataagtactgtgatttatcttctgtcctggactgctttttccacccacgttctatgtaattaacctcttaacattataccctttcatattaagttctttgcttattgtgcagagatattttcaccatggcttcaaatttcctatctctggaatattttagtcatttctgaaactcctctaagagtgtatggttcacaacccacaacaggaacctgaaggtgatactacagatttaaagtagtcttaatgatagtgaaatgacttgaaactaatagtcaatattttagtgttctggtttcatttttggattttattccaaaacctccagaagtacacattcccattattctacaatgctccattgtgatgtgaaaaatataatcactggctatgcttttaaacagccataatatgtttccttatatctgtagacaacttttactttttaaaaatagcattctttaaactgatatatttctggattcaaaatattaaaacctcataaacaagataacttttctgcattataaccaaactaaataatactaattttttacataaattatgtcttcgcatatgtacacatatgcacaccaagttatatgcacattttacttgacactttgagaaaaaccacaagatccaaaatcacaaagtgaacaagatcctaatttgattttcgaaggggagggagattttatcttaaaaacataggcaaccatttttgttttattgtaccttaataaaagcaaacttttacctgggcaagcatggggaagccaaggttcctacatccattacacggagttaatgcttcccaaagtcctgatggcccacacgtattttcatcatcatcctcttcttccacttctcctggtgacaaattgattgtagatgaggttctctgaaattaaatttatatcataccaatatattatatcaatgatatttagatatcttaacatcaattaaattctataaatgacagtggtatatctcggcaaacaagtcagctcacttttagccacagttacatggctgtgccctgtgcctgagataaaaatatgtatagtccaacttaagttaaaagtgaaaaaaactaggtgtgaaagacttataaaataatatatgaagttcataatgaagaatagaacatgataatggcctaataaaatatttgaatagcaacaaatgagaaaaatcttatggtttatcaagaatttaggtttaggcataaaattaaggaaaaatgcagttagggcactaacaggaaaatattttattgaaatgggaactcctgataaaccagtttgttcagaatgccactgaaataaaactttataaactttcatatcatacatataacaggagtaacagttttaaaattcataatgagacttccatatttagcacatatattttccttcgttatctcccaaatctcactaaaatgatggtagaacatttataaaaatgtttacaccataaaaataaggatgacaggagagatgaacagacaatattaagaaaacttctggataatgttgagtaacttttggataacagatgggtattacctgacttagcaaacatgagaacactgaaagcaaagaaccttcatgtggaaagaattggagggactggctacctgtgaaggtgtaagtgtaggtggggcagaaacagactgaaactcagtatcagaaagaattatacccctagacccatctccttttcacccagccaggaaactaaatctttaccactggcaagaaattagaggtttaatttttgaagaagttgaagcaaaaggattatgaattctaagactacagatatactgagtctccaaaaacaagagaattaatatctatatagtaatgaagattcataacctaccccgtgccttaccatatttgcattagacaacatggcagcacggtttatattcccagataaacaactagaatactcctccctgtagaaacagacctcctaagaaaaaaggtctataaataagcaggaaaatggtgggatctatgtatcaatctctactgtgaagccaacctctcaacaagttccactcacaagaatcatatatttgagaaaaacctcttaacagacaccaaaataaatatagagaaaaaagttataaatagtatcctcagagagaagatatttatagccatgaaacaagaacagaaagttacaaaatacataaaatccaatacaagagtaagaaaaatctgagaaaatttcccaaaagatgaacagaatttaaaagtggagaaaactaggggtcaaaccaagacctctaacatctgaacaaaaggagctccaaaaattaagagtagagatgggagggtcaaagaaataaagcatgaaaatttgcagaaactgaggaaaaacttcactctaagagcctgctgaatacttagcagactcaatttaaaaaaaaagatgtatatgcataaataaaaagaaatacactaaattgtctaaaggtcctctgaatgtagcgttcagcacaacattgatagatcatgattactaaagcaagtaaatatattctacatattggattgtaaatagcatcctccccccaaaattgttccttttaaaaatagaatataagattttatttttcctcctatttaaaagaatttgttttctgcattcacattttaacttccccttgatcacttgtcagtaactaagaagcaatgaaattaagttgtcccccaatcagttgctgtctataaaatacaataataataacaactgttagactgagaacttactatgtgacttggagtatcactggcctattgtctgttaactattttaattcacacaacagccatttgaggcaaatatttttcctctcactttataaatgaggaaactaagggacagagaggccaagtaaaacccaaggtcacgaagctggcaagtggcagaaaaaggattctaacccagactagggggctgcaaaacctactctcccctcaccactacattctgtgaccactcctttggtacaataacctgtggaagacaatatactgaaaaaccacactgatgtaaataattgcagtttaaataaaagaggtatatttggtgaatacgtttctgttacacgagtaaagtcctgagagcattttgccttctgtgacagggagtgaaaatttctgcaatttgatacatagcagcccatgctttcataaatacacacttctcaaatcaataatagaaggtgattatcacagggatttttgaccctacagatcctttgagtaaaataaaaaatcttgggaaatttaaaatcttaatctgaaagagtatatatatatatatgataaagttgttcacaggaataaataaaatgatcaaaaaggtatctcctttaccagctcatgatcagctaacagtttgaccatcaacattgatgcggcacatactataaaccacctcatagttggccaagaattatcaacattttagattaatccattcttttctattttgttaatggtgctacaatgatttaatccaatcacacagggaacttcctctatctctttctcctccctcaaaaaaaaaaaaaaaaaaaaaaaaagcttatctctcttccctgctcataaagctccaattacttcccatttcacagcaaatgatatccaaattccttaatctggcttcagagttctatagtcaaatgattttttagcccttttactttttcactatactcacctcagattataaccaggtggaattgtttacccttgcctaatcatgctctatgcttttattctttctttcaccttacttgtctgcacagcgtattgtagtggttaagggcttgggctctaaaattagacagtcctgaattcaagttccaaatacccgcctcactagccgtatgattttcagcagataagaccattgtcagcctctcttgccttatctatgcaatggaaaacaatacagtggaacctctctcagggctttttcctgatgactaaatgaggtaataaatataaagtgcctgacacatacagcttcaataagtattaactatcatgtttattattttcttataatcccactgattcaaaatagagttcagatttcatcccttacctaaaattttccagatttcccacaagcatgcatgatatcatgttcttctgcttgtctctctttgtgcaaatgtttgcatttggtatttcacattcaccttgagttgatagatgctatagtggcaaagagcattggcttttaactcaaacagatatatgtttaaatcctagctctaccacttccaagctttgtgattttgagcaaatcacataatcttattaatccttagtttccctatctgaaaaaatagtgtaatcatttccacttgcagggctgtatgaagatcaaattaattgcttgacagagactggcacataaaaaatcaataagtactgctattttattttttaccataaaagagttgtgtacacacacacagtgtgcttgtgcaaatatactacacagacacaagtgtggcttatttacccttgtgaagtaagttatttgaaagaaaacattgccttattcacattgtatctcctacaatgtgttgtgcataatgaaacaataaatatttattgaatgaatcactgaataaatgagcttcaaattattattttcatttgactacctagaaaattttactaatattaaggggtgtgtataattgtatcacaaatatcaagattgccattttagctttattttatattaactattacaagtagctttgcagaaatgaagaaacttatcagtggtttagcactgccccctaaagacagcatataaattggctgtgtaaaaccataatttttaacttcatttctttacagttaaagatttgaaggaaaatattttatcaagctacatataatcttcaattatatatgggaagaagccagcggaacacacttaacctcagatggtttcatttattccaaatgctgttcaaactttttactggagaacaaactctgttcctgaagttccagaaagatgtgaaaattctactataaaaaaaaatagacctaaatctatacagtttgaacccattagctttcttggttattacacggtaataaagaaagactggaccaattctatgttgttgcaaattgaaaaacagtcacaataatatactgtagggagacaaacttgagctcaatcaaagaaaaacacttttgagaataattatattagtctaacattgaagaaatgggatttccctgtgaggcagtgtgtgttcgtgtgtgtttgtgtgtctgtgtgtgtgcatgtgtgtatgtgtaaattatatgacaactatatataacggtgcttcataatttataaaatgctttcagatagagaatagcccaataaaatagagtaagaattatccctattttacaagtgaaaaaaactgatgctcaaaatgttactcgatttgcaagatcatactacaaatcagtccagattataatccaagccctctaaatctaggtcctattgtctttctaccacaccatggaagccacctccttaattactagaactcttcaaggggacaacaaatgttcaagattgtcaatgcaaagggaccaggccaaaaggcagaatccaggaaagaggcaatatcagagatggcaatcaaagcaaaaggcaacaatctggaatgagttagcaatctagactactttatagcattgccacacgcctttttgcctttgtttagttctaaagtaaaattgctttatagatttttcaatgaaatttaaagtaatacatgcttattgtaaaacaaatcattcataatgaaaaattatacatgaaagagtgaagctttcctagcctcggtcccacattcagtgggtgtacttccagactttgtaatacttactctacttgcctgatgactttctcacgataaattcataaatgagaaattgtatacaccaaagagtatgcctacctttatctttctttttctttttcttttttttttttttttttgaggtggagtctcactctgttgtccaggctgcagtgcagtggcacaatctctgctcactgcagcctccacctcccaggttcaagtgattctcctgcctcagcctcccaagtagctgggattagaggtgcccaccatcacacctaattttttgtatttttttagtagagatggggtttcaccatgttggccaagctggtcttgaactcctgacttcaggtgatccacctgccttggcctcccaatgtgctgagattacaagcatgggccaccgtgcctggcctaaactttctaagtattgccaatgttgtctttaacctgttcacagtgatcagagaaatgttttttcatatgagaatgtgatcatgttttcctcttccttaaaaccttcaatagcttttcatgttcttctgataaagttcaaaattcttaatatgatccaaaaggctatgcatgatctgcccctacctccctctgtatcccaccactaatctggcaggccaggtctcactaacagctgaacaggaaggcctccatgacaactgtttcagcactgactgagtggttaaattaaatatttaaagctgatagagccagtgcccttatacgaaggctggaatgtaacgaaagcccaccaagagttttgcctaggcctttccagggccttgaagcatgatgaaataacaaaggaattcttaacagaacccgtttagtattaaacaggttttactgggggtctgaaggaactccccagacctccacaaacaagttttattgaggtctaaaggaactcccaaatcttcatgatttagcaggagacaagataagcgtaatcacccctggcacctggatccatctagattgagtaaatttactgaagctccagaggaaggtcttcaggactcagaccttaggtatagatgagaagaagttaatcacttatgtctttagatgaatgcacacttacatgtagacatacagcttagaaggtatataagctctggaaaactttgtaattttgagttggtctggcaatattttccctggccttctccctgtacccgtttacagaagtaaattctcttctttcccagttggtctgcatcttgttattggaccatgagaataagcaacccgacccttggtttggtccaggaacactaacactattcctctcctttgcccataatgtttaaacacactgagcttccctctttccctcaagtataccaaacttcctcttgcctcgtaccttaccttagcacatgtggttttctctggcaaagactattagtcatctcccaatatacagtcccccctcctccttttgtctttagtaacaccttcttttattcttgtatggtactaatactccaacttttagctgggcacatgtattctttgaataaataccacattgtccagtgtctgttgcagctaggtgtgaccacatggctaagtcataaccatgggatataagaagtgctcttgaagtgaataggtgtgcccttcttcctccccttcctcttcctgctgattgaatgctaatgaaatagctggagctggagcatttgtcctgggccatgaagtatccttggaactagaggacctgcacaatggaacaacaaaatagaagaatcctgggttcctcatagaggtgatccctaccagccttggactgcctagctctaagctttagaagtgggagtaaaacaaactctttctctttaagccattattattattttagatgtttttgttatttgctattgtgtcaaaccctaacaaataaattcctttgcttgtcttcatcaggattaatcttattggtgctttaggtataaatataattcacttcctttggaaggccttcttgatgctctcatcaagattaatttcctttcttatatgccttcacagtatcctgcttttctaatagcaattatcacaatgataattttatagttactgtgtgactttggttcagtatctcctatccttagtccataaaagctgcatgattgcagagatgcctgttgggttagctaccaaagcctgatacttggctagtacattgaataacagtttatcacatatgtgttgaaaatgaatgaagagtaaatgaatgaatgaatgccagcttgccctcatagatgttttattagtgtgaacattttcactagttctaagaggaaccaatgtaactataacccagattttaatgtcctttgttctctaactccatttgctcccactgtcttccttccatattcaaaataatgtagaaaacagcatctatttgatttcatgaaagaatacatttatgacaaccattggtgcacaatttacattttaccacaaactctatagcggaggtgaatgggctttaaattgcacagcttaactcctccccctcccctatcaatatttttctccttatagtaataattgggtagaagggtgcttttcatctccccttccaccaagaagaatagaattcttggtgtctatttttgcctgcagactgttttcattagctctttaaattcttctcctctttattatgcaagcaatttcacactaggatacatcttatctgcaaatttgcatagccaatctcattacacaagagatcttacatgagaactattattttgtcaatttaaaaggcaacaactatgtaatagcatgatatatcatattttcctttttacaatcttttaaaaccggggatctaagggcttaatggggcactaagaagaaaacgtgaggtgttaagctggtttacttattccaaagctatgatagtattaatgatcagatagatgataggtcagtgatcatattactcacaaaggaacagactcaaccatcttaaatttagtcctgggagagatatcacatgccacagttgaatatattagcaatgatcagaaaacctactgttaaagccacagttgaacatattagctatgatcagaaaccctactgttaaatacgtttctataagcttagtaacactaaacatctgttcaaaattttctgaaaattaccttgcaaggctaccctacactacctttcaccacaaccatttgttccatgttagtaaaattcacaaaagctgcaacatttaagtctgctgaaaaataaaatttctctaagattaatttggagttagctgtgaatcctgtactgcatttatatctgcaaggaaaagaaaggaagaagaaaaacaagtcttgatgccaatgagtacactgagtacatctcctagtatctgcactctgaaatgacgttactatgtatggtgatattttaaacttgaggatttgccagtgccaaatgtatttcacatttattgaaggacagaattgctattaaagcaattgttttagttgcaagaaatattgaacaagaaagtaaggatagtctttctctttttaatagtacatgagacattacaattcctctgaaacgcttagttccaacacattatgttcctgcctgctgtttacatatttgacatcctttgcataacatcaggaaacttcaaagaacatattttgtttgctattctacttatatacaatcaatttgaacgtttttattatctctcaaaacttttgttcatttatctgacccttacctagtaattaatactgtttattatttcaatattagaaagagctaagtctaaactgatgccaattttatgcacaatacgcagaagctaatttcaaaaaaaaatgttaaagtcaccttagaaagtttaaactttttttttttcaacaagacagtacagaaggcaaaatgtataactttgggaaaactaaattatcctccatgacagatcattttatatgaacaaataacatttttctaaaagtttacttctttgttttaaaataaaattcattaaagtcttatttatatacctaacatgaacccattttatatatttattttttgtattggtacaaatctttaatagaatttttatttaaataggggattcttatgttactttaatgcaaaatagaaagaaaacaaatgaaattttatataaaaattaaaaacctaagagtaaaaaggtagatgtatgtagaatcctccacagtcagcgtacagtatggcattttcaaaaagctgagggaaaaggagcaagaaactgagaaggaagcaaaggagaagaaaggggagagtaaagaaagaaagaaaagatgacatgcacccattttaaatgtacatacctgtgcattcaccaccacaatcaagatacagaacatttccatcaccgcaaaaggttaccttgaatccctttcctatcaatatttccctactggtagccccagaaatcttttttctgccacaatatagtagcatatacactttatgtttggcataagttttctgtaaagcttattaacactaaacatctgtttaaaattttctgaaaattaccttgcaaggctaccctgcactatcttttcaccacaaccatttgttccacgttagtaaaattcactcagcctaatgtttttgagattcattcctacttttgcatatcagtagtttattcctttttaatccaaagtaatattccattgtatggctataccaaagttttgtttatacattcatctatttatgggcatttggttgttttcagcttgcggccattacgaataaagtcgccattaacattcacattaaaatctgtgagtgcccataagtttttgtttctcttgggtaaatatcgaaaatgctaggtcacacggtaaatgcatcaaactttttaagaaactgctaaagtgttttccaaagtgtttgtaccattttacattcccattcattgtgtcggagagtttcggtagctccacattcttggcaacacttaattttagttattctaatgggtatgcatgtagagttatcgcaatagtatgtagttatcaaatggtatgtagaattatcacaataatagtacttttaatatacatttctgccagtgctactaatgtgctaaatatcttctcctgtgcttagaggccatttaccttcttctttggtgaagtacctttacacatttttattaggttgttcgacttctttttttttttttagacggagtatcactctgttgcccaggctggatggagtgcagtggcaccatctcggctcactgcaagctctgcctcccaggctcacgccattctcctgcctcagcctcccaagtagctgggactacaggcgcccaccaccacgcccggctaattttttgtatttttagtagagacggggtttcaccgtgttaaccaggatggtctcgatctcctgaccttgtgatccgcccgcctcagcctcccaaagtgctgcgattacaaccttagcgtgagccaagtttctttgacttcttattgctgtgttgtaagagtattctttttaaatattctatattctagacatacctcctttgtactgttggtgaatatataagaaatctttgcctaacacaaagttaagatattttcctatattttcttccataagtttaagatttttgcttttacattttgatctttgttctatattgagttaattttcatgtacagcatgaggtaaaggttgagatttaagaaacctatttttttaatatataagtagaagtagtcagccccattacttgaaaagattatcctttccccattgaagtgccctgcagtttttttgaaaatcaattgaccatacgtgtatgggtttatttctgaattctactttgttctattgacctgtaaatctcttcttatgtgaataccacattgatagacgtttataagcctggaatcagagaaacctccaaatttgttcttctttgaaattattttggctattctatgttctctgcctttgcatataaattttagagtaagctgtcaatagctgaaaaattagcctgcttggattctgcttgggattgtagtccatagtacaatttggggagaacaaatatctaaaccacattgtccttcatttcatgaacatgatggtatatccccgtaggtattaggttttctttaatttccatcaacaatatttttatagtcttcagtgtacaggtcttgcccatatcctgttaaatttgtaggggtaaatttgtaggggtggtatatctttgcacgtattaggttttctttaatttccatcaacaatatttttatagtcttcagtgtacaggtcttgcacatatcttgttaaatatgaaggggtaaacacacgtttcgtgtttctggaaaatctttcaaatggtattattaggttaatttaattttcttttccctctagcactattggggcataattgacaaacaaaactgtacatatttaaggtgtatggcatattattttgctatatgtataattgtgaattaccacaatcaagccaattaacatctccatcacgtcatatagttactatggggtgtgtgtgtgtgtgtgtgtgtgtgtgtgtgtgtgtgtggtgaggacacttagaatcaactctcttagcaaatttcaagtatacaatgtgatgttattaactatagttaccatgctatgcatttgatctccagaatttattcatcttataactgaaaatttgtaaccaaacttcaaatttgtaccaaattttaaaattgaattttcagctgagtgcagtggttcatgcctagaatcccagcactttgggaggtcaaggcagatggatcacttgaggtaaggagttcgagacaagcctggccaacatgatgaaactctgtctctactaaaaatacaaaaaagtttagccaggtgtggtggcacgcacctgtagttccagctactcgggaggctgaggcaggagaatcacttgagcccgggaggcggaggttgcagtgagccgagatcatgccaccacactccagtctgggtgacagagcgagactctgtctcaaaaaaaaagaaaagaaaagaaaagaaaagaaaaccctgaattttcagttactgatagttcctcatgtaaaaaaaaaatttgatttttatgtttatttactttgcatcttgcacacattttaggtctagttgctttcctatagatattttaggattttctatgtaaatgatcatatcacctgtgaataaagagttttacttttctctttaaaatctttatgcctttattttctagcccttgtcttactgcactggccagaattgccagtacaatgttgaatacaaatcttaagtgaaaagcattcagcctttcaacattatgaagtataatgttagttagctgtggcatttttgtaaaggctttttattataaggttgagcaaattattcctattctcagtttactaaaagtttgtatcatgaatagatgcttttctacaatgactgatatgatcataaggttttcttcctttattctgttaatgtggtaaaatatattaattgattttatctgttaaaataaccttgcctttctggcatatatcccacttggttgtaatgcaaaatttttaagtgtatgccggacttgatttgttactattttattgaggattttgttactgtgtttatgagtgatattgatctatagttttccatttgtgaaatgtctttgttatcacagtaatgctgacttcatataataaattgggaacaacccttatcttttattttctaaaaggatttcaccagtaaaccacctctatgtaaagtttccttgtggggaagaatttcattatgatttaagcttccttaacataggattatttagattttatatttcttcttgagttacttttcctaatttaggtctttcaaataattcttccatttcatctaggttgtcagttattgctacaaagttattcatattgttcctttattattctattcattctcctggatctttattcatatcccctcccttttatttctattggctgtttatattctattttactgatattgattttaatcattctcactttgggtttaatttcctcttttatctcattttttttaaatgtggaagcttaggtctttcatttaagacctttctccttttcctatataagaactgaattctatgagactcctaagcactgcactagctttacctacaaagtttaatattcttggttcttatttgcatttagttaaaaatattttctaagtttctttgtgactttagcaactagattatgatgtatctttgtctagttttctttgtttttgtcatgctttgcatttgttgagcttcttgggttggtgttttcattcaagttagaaatttttcagccattgtttttgttatttttttttgttattctttcattcctaacccctcctctccttctgaatctccaattacacatatgtttcattgcatgatattttttcacaggctctgttatttattttagtcatttttttctctgtattttattttggctactttcatttgcaatattttccatttcaccaatcgttccttctgcaatgacagtctgctgtttattgcatctactttatttttcatttcagatactgtctttttcatctctagatgtttcctttgaactcttttatatctacatttctctattcatgtcacctcttcctttaaacctttgagtatatcaagcatatttatagcaaatattttattctctcatatacaaattctatcaaatctgtaattccaggcctatttttattgactaattttttgcatgttcatgactttcattttccttattttcatgtgtagtaatttttttaagagaaggcttctcactctgtcacctaggctggagtgcagtcatacaatcatagctcactgcagccttgacttcttgcactcaaatgatcttcttgcctcagcctcctgagtagctgggactacaggaatgtcccaccacacttggctctgagtgtagttgtatttctttaaaaattactggacatcgttgtggcatagagtaaagttatctggagatcagtttaattcattcaaggcttgcttttactttttttttttaggtgggtctacagtaacctttactctggagctaacttaaccccactgttaagacttacgttccctctggaatgtctagtgaatgtgccatgtattaagcatgatccctctacttgggctggtagttacttgaatgattgttggccttgtgtgagctccagggatttttctgtttatgtatctccagtattgttctttctttggaggtttttctttttctgtcttcatgaagtttcactcttgtgcagattgatattcaactgaagatacaaagataactttaggttgttttctggacctcttttttggtatagtaccctcttttctgttcctctgcctgaaaattctagctgactcagccttccccaactctagtttctgtactttcaactcagaggattacttgaccctgtttctgtttttctacctggcaccatatttaggaattggattcaggcaaaaagctgggtgatggtagggtttgcctcctttgtatcttttctattagggatcacagtcctgtcttttatccaggtctgatcatgaatgtttgacatatttttgtccagtattcagcagttttcagaaggagccactccataccctattacctcatggaagtttgacaaaacctttaaaggtttgacaaaaacactttttaaaagaagacgtgtattattcatatctgtttctccattttagacctttcttcacttcttaccggctaaataatcccatttcctctattttgtacaaatccctcaaacatattaatattctcttcctccacactgttaactgcacatttatcacataaagttagtcttttctttccatcatcatgcttgtcttgccaatttcctaattcataataaatagatggtcctaggaaaacaatctcacctgtaatatgagagttattcaattaattttttgcatcagtgaatacacataccttttacaaccaacctgaacttcctgtgtgcataatttcattgctacttaacttaattaaaaaattattgtttatgcccaatatttcaaataaatttatttaaatttattaaatatttattgattaaaaactactgtctacaaggctgaactctaggatgagggaagaaaaatataagtatgtcataaactctgaactcaaggtgtaaagacacatatctatacataactagacagtaaaactagaccaaaattataagcattacagagatactaaaacaaggtattagaaaacataaagaggaagcaaccagggcaagtagaggagagaattcacagagtgtttgcatttgagcaaaagcacctcatgagataagaattctgacagagaaaaggggagatgggaatgaggcacagagtttgcatgattaaggcagtatgaatgtgcttgctgtgtctggcaaatgagctattaggaaaggcatggtggggagatggtacatgaaaaataaatcagggctctattatgtaaaactgatagtttaaaacaagttcaacattagtcaaggcacaattttctacttcttattctactgagatcaaaaaatagaaagcttctacgtattagatacaaaaggattcagagactgtttctcttctctaaattcccataattcagatgtttggacaactcaatctattgttttgaactattttctggagattgcatgaagtatatcttatctctgtaattgcaagaacaatattttctattatttgtgtatcctgcaagatgactagcacagttcagggcacatcatgtgtatatacgttttgattagacaactcttgctctttcacatgttctattttgtccttagatgactataaaatagaaatgctttcagtgctgatgtttacgtaaatatgtacttgtatgcatgtgtgtgtgtatattggactgaaacagaaattaataggcatgtttgatcaaaaaaatgtgaagaagtctctcaacagccccgcaatcaaaagataaacacccccattattaaatagcaatattttatccttttcaatatacaacatatattccctgtcttttctcatctttatattgtatacatattatttctatcatattttaagccattttctgggaaagcagttgttcagttacatgaaagtaaaatttgggagaaaaagtatataattaaaatgtatattaactaagtcatgataaatcatcaaaacttaggactgaagcattttatattgaaaataaaatgaatataaattagacattaagtctgttagatcagaagtctgttagaactgactaactctagttcacgacactaaatcaaggtagcagaaataaagtagtatgtggtactactccagatattgccaaatttaaaatgcttcttttgtatgctcaatagcattcagtaaattttttttggttgaaaaatttattaattaacgctagccaaagaaaataaaacctgatgttttctcccccaccccaaataatctttaataaacatattaacaatgctgagtgattttaaaactcttttcttttttgagataaaattttttaagtggaaaagaatttttcagatgtaccaagacaagttcaaaaacatggcaatatccttcaacctatgcaacattctcaccatcttgtcagcatttaattaaatctccctgacccaggttcaaatgccagaattggaatacctgaaccacatcctatctagccaaggcattaaacccatgctggataagtcttctgtctgagataatgaagtaggaggtacccaggacaatcaaagacatcagcaacttctgacttaccaggtttactgttaattcattccccatttcttcactttgatcttcctaatggtgaactaatttcatcttcaagaaaaggaatttttctactcttcatctatggatttccatatctgaaaatccctttcaaatacacgtaactctgaccaaacagaactactccaaacatatctgaccctgtgccactaaatctgtcagttacaacatcaccagggaatgccatcctgtcattgcataaagacaaaacctcttcctgtggcagcctgcagctaataactggttgaagaagtgcagctacctcctccaaactgagaacaattctgaaaggtcaccccagcttctgagttcctgtgatgttggtcaagcagaaacagatcattcagtggacagcacctacagaaaccttctccagtaaggtgtgaatcccaaccttagggagaggtgctctcttccatgattgtccttccttggatactctcccccagccatagaatacctttatagtttgttttacatatttatagttactctcctatcatagtttaataatctttggtgttaaactttcttgggaaacttcaacacagaaatataagcaggaaatgataagaaaagaaaaggctaatgttgagccaaagacacaataaaactggttgaaataagaaaagaatacattatgaaatttaaactattttgtctctaaaagccaaactgattttacataaaatcaaattagtgttttggtggccaaattggagacattcaccaaaatccataccctcaaaaaggtcagaaaacatggtgtatcaaagaaatcaagaacactgatctattctaagaccatataatcttaggtgaaaaagcctgagcagagaatacaaacgaaataatcaaaaatataatagaagaaaactttccagaatcaagaaagatgaggtatacaacaaatgcctggaagaactggaaaataatcatatcaagacatactcaggcaaaatcttttaattccaaggaaaaagaataacctatccaagcttccagaatgaacactcagattgcctactgtactagccaggattcttagaggcaaataatagaaactgactctgttaagtaaatcagatactttgtttttacatcccaaacatccagaaaacaaagaaaatttaaaaatcctgaagtccaccatatctatgccaagaagaaaaaatattatgttgaccttatatttttggaacatatgcaatataaacaatagtataagcattatatgacataaaatgtcaacagactactcaaggtacaaggttataactcaagaattttataccaagaaaagttactggttatgtttaaaagcaagacagataatgcagtcctcatgaataattcttgagataatacatttatcctatttgaaaataaattacaacttgccaagagacaaattaaggaatcaaaaaggtgcaacatgtcatataaagtataattcatgaatattgaaataaattaaatacaaagttttaagcataacaatatttattaatataattatagaatatggttattaatatggtcattattttcagtgaaacaattacatatttatagaactcaagatcagctcaaaattataatttagaagggtaaagtatggcaactagttacaagattaatataaaaatcaacagtctttctatttataagcaaagacttctagaatatacaacaggaaaagaacatgagtcaaaaaatttaaaaatcaaaaattaaaacaactaacaataaccttaaataagaaacgttggtgccctagggaaataaaactaattatgaaataaagaaatacatgtcaagagacaaaggaaaattaatttaaatggagaaaaatgtcataataatgtttgagaaagctgaacttttcaaagatggcaaatcttcctcaaataaaagtgtattggggattataataatttatggatgctttatataagttatacataaagtgagggctgaaactttgtcatattttattatatctaagactagaactgtacataacacacatttgtttaacaataaatactttccaataaatggttaaagtaataaattaatcctagctggacctgcaaggaaagatggcaatatgaatttaaaaaccgctataaaataaaagaaagaagagaagagctaaggaaatgtatgacaaagaatataagtactatgaaaagtaaaacactacaggacttgtgcaagaataatagagtaaatagttctagttcagaactgaatatataatctttattataaaaacacatgaaaaagaagcaccaaagtttataaaaaataagtggattactcaataaactatgatgggaaatgagtttatgtgtctgaaaacaaaacatgcgaattgaagtcttctgtgggaaaaaataggcattttcttttaaaggcatttctactataaatagtagtaaatataatagaagaaatgatttatagacttcatttcattaaaaaaattaacccctgtatttgaacattaatactaaaattctaaaacacgtgaaaactttggaaaattatttacaataaatacaacaaaataataatatccttaatatgcaaagactctatataccagtaagaaaaatagcacggtaaatgaaaagcatacaaaagacttgaaaagatcattttaaaagtagtacaattgaccactgatcatacaaaatatgtttaactactttagtatttatagcaattaaaactcaaatagcaaggagataacatgttttatcaatcaaactggcatgttttcaaaccataatgtttggtgaggggctttgcattgggaatgtaaattaacaaaaatattttgaaggataagttggtagtatgtgtaaagaatctttaaaaagtttcttctctttcagaaattccacttctagttatctatactaagagaataaatgttatatgtatgtgtaatgatattcattattccattgatataaaagcaaataattgaaaacacttaatatttaactgaaaaacactgttaaataaattagagtatatctatgtaagaaaatatttaaagatctttaaaatcatattctcagaaaatatttagtaatatgaaaaattgtcattttattattttaatatgttgcactgttttaaaaagtagtataataaaccctaggaggataaattccagttttaaatgttttttaataaaatttatctttaaatagtgaaataatggcctatttaaattttttaatacttttctgaattttgcaaactttcaatgatcaattcagaatgcttttataatcaaatattactgatgttatatgtgtcaatgaagttatttcacctctaccaatctaacccaaaaaaaggtagatgtgcacaaagattttttactcaaggatatttatcatcatattatatataataaaataaatgtataaacaatctaaatgtttaaccatagaaaataattaaattgtgctacctctgtgtgtatacttttatatattaggatattattactataagtaaaatttcataaaatgttattggcatgggaaaattttcatgaaaattaagaaataaaatgcacagcatgattctgtttcatttttatagtgacttgtgatagggtttggctttgtccccactcaaatctcatcttgaattgtactacctgtaatccccacatgtctttggagggacccagtgggaggtaattgactcatgggggcagataccctcatgcagttttttgtgatagtgagtgagttctgatggtttcataaggggtttttccccctttgcttggcacttctccttcctgctgccatgtgaagaaggacatgtttgcttccccttctgccattgttttaagtttcctgaggcttccccagccctgtggaactgtgagtcaattaaacctcttttcatcataaactacccagtcttgggtatgtcttgatagcattgtgagcatagactaatacactcgcatatataaaaactaagataaaatatattaaaacacatctctgtatgacaggtgaattttcattattcatacatatcctattttccaaattgtctataataagaaaaaacaagctttttaaagaaaaatggaagattattcctccatttagaatcccataatactaagtgatttgttgaaatgttcatcagaatgcagaggcaatcctaagaatttaactgcaaattacagaattttcctatcttcacactttctaattgccaaataatttataaaaataagtaggacttaatttcatgacatgtattaaaataaataaagtaaatggttttcaatttgaaatattccattaagtcttttctaacttgagcttatgaaatgcatgcttgcttcttgtttctttttaggcctttgcttccagaaatgttaaaataacatgattactaaatatatctccaagtttcatacagctactgtgaagtcaaaatctggaaaacaagtagaaaagtggagtacttactgttggcaagaactaccacagatccctaagactattgttctataaatgttaaattataaagtgatacaaataaattagattttaaaagggaggaatggagtaggaagaaggagaatgtgttgtgagacacagtagaacacacaggaagagttgaggtatatatctttattcttactgacatatatcccaaataaatgaaagcaaactcaatatttcatgtattcagattaataacacctatttctaattttaatgtaataggttctttaacaaaaagttttcaaaatatttcaaagggcttataaaagtgaatctttagctttcttctaagtacacttttgcgctcctacatctttcatagcctagacctaatttctagtttctggcctcatctccgtttctaggtcctgctccacagaggtgtgatcaggagggccatgcaccattacaaaattgacatgacttagatcttaaaagcagtaccacttgcccctcctccaaactgtttgtttttttatttttttgttttttttccttaaggctgctcaagaaagtagcaaataatatagcctaaataatatatgatttgttgaggacttttttggaggagaggaaagggatgtgattatttaaaactgcacaagtgggaaacaatttccaaatgcttttcagaaaatatcttgtaattagattctcttttaaaactactaggactttgaagtaaaataatgtctgctgctgagaacactgttgaattgcagttaactcctactagtgatcaaaatgacccagtcaaatctccagctgcttatgtaattctgaataaattctccattttttaagaaggatacaccaaagaaataaagttcagtttgtagtggctcacgcctgtaatcccagcactttgggaggctgaggctggcagatcacgaggtcaggagatcgagaccagcctggctaacaccatgaaaccctgtctctactaaaaatacaaaaaattagccgggcgtggtggcacgcgcctgtagtcccagctactcgggaggctgaggctggagaatctcttgaatgtgggaggtggcggttgcagtgagctgagactgcaccactgcattccagcatggacaacagagcaagactccgtctcaaaaaaaaattttttttcagttaaaagatacccactaaaacaactctgtcttggcaaaaattgcaacacttcaataagggagaatatttggcatgctccattcattactctgttgtggtgtaccttacgagagacaaccaaataagatagaacaaaatctatgttgagaacttactgttctacttaacacaggagtggagtacatactgttaccaagaactgccacagagccctaagactatagttctataaatgttaaattacaaaatgatacaaatcgttttcatgattccaggaagatggcagcctgtgtctgtattctctattccttctccttcctaagtccctggtgtggctacttttcctagaaaataactaagtgtactcttggaggctagaaagaacctggaatcatctgagattttaagtcctaaaaatgaagatataattctggcctaaaacttactggacagtggtcagaaccccttctaggctaacttctcctacataacttggaacaaatgtcacagattcccggataaccacaagcaaggagagaaaattctcctacctgtttactaagagagcccaagtgtccctttacactgtagtgttgggctaagtacaatccatccctgggctaagtacaatccatccctgattgcaccaaacttaaaaaaaaatctctttttctaagcctaaatttcactaaaagcactctggagctaaacactcccatttaattatttattgttgtttaattaccattttcttagagactccaaaacctgagcagtacaggtgttgacagatcccatgtccaataatatgaatgcccattaatatgaacaataaggatcaacaaaccattttatgagacagtggcttaaaagaagaaaacttagatgatcaacaagagtagtagaggtaaaaataacagaggacacacaaaaaaatggggaaaaatgtactataatctcttataaatatgaaattagaatgtgtaaaaacagtgtctagaactaaaagaaagaactcttgaattttaaagttcagttgagaaaatgaaaacgtcactgaagaaaagtaattttgtgttttagaaaatcaagtgaagaaaacagaataaaaatgaaccctgataggtatcaagtacagattaaacatttgtaagttggtgaataatgggataaaaacaaatgaagatgtgatcaaagaaataataaacaaaagctctcctcatctgaagttacactcagattaaaagagctcacttgttaaataatttaaatggcacgtatttaaagataatctgatgatttttgaactctaaagttttgttgttgttttgtttgagacagggtctggctaggtcacccaggctggagtgcagtggcaccatctcgactcactgcaacctccacccccaggctcaagccatcctcccacctcagcctcccaagtacctcggactacaggtatgtaccaacacacccagataatttttttttattttttgtagaaatagggtttcactatgttgcccaggctggtctcaaactcctgacttcaagtgatccgccctcctcggcctcccaaagtgctgggataacaggtgtgggctaccatgactgtccgaactctaacattgaactggaaatattaccagtttcaacaagggaagagaaaagcagatattttcaaataaaaaagaaccaaattattatcaaattcttaactgtaacatcagaagttagaacacaatagaccaaccattgtagattatggaagaaaataactgttaaaaataggcagctggacttgaaatcctgcctaaatatgggaaatggcagacaggagtcaggactaacttgcagcacccactcggatggagagaacagcatgtggagactcacattgtaaacttttgctccaagaactgccataggaacataccagaaaaactgaaagaattcacagatcctttgaaagaagcaccttgttactgcaaactctgtgagacagttgaaaaaatgtcttgaaaagtgtgaaaggggaaaatctgcctccaaacacacatcctccttggggaacctgaaaatccagaccacgggagaaggatttaaacttatctagagctgaaacaaatttagacagccaagcaaaatacaaaagtagaagaagcaggccaggtatggtggcccatgcctgtaatcccagcactttgggagacgaaggtgggtggatcactcgaggccaaaagttcaagaccagcctggccaacatggcaaaaccccgcctctactaaaaatacaaaacctagccagccatggtggcacatgcctataatcccagctggctgggaggctgaggtgcgaggatcacctgagcccaggaggcagaggttgcagtgagccacgatcacgccactgcacaccaggctgtctgttaagactctgtcaaaaaaaaaaaggaagaagaagcagcagcaggaagagccctgtaggcagtctcaggggagccatttctgactttatctcacaggggtctgtgggagggctgcaagtggaactggggaaggaccacagggagaaagaaacttccagctgaacttctgtaataattttgaccaagcatgaattttcctgggcagaatcgggggagggggagaataggaagtgtggacataaacacagaaactgcggcaggcagggaggggtgaagcctgaaatccctgcttgctttctcagctcttagtgggtaggcttgtagcctggtacaagatctcagtactgctcacaggctccctgtatataaactcagtgctattggaggggcgtggtaagagttagactagccttactggctgcatgggagctgagtgaggcccgtcactgccagcttttccccacttccctggtgacctgtataatgtacgagaggcagccataatccccctaagaacataactccattggcctgagaaccacaatcccatcccccacagaagccatagcaagtcctgcccaaggagagtctgagctcagacacacctaacccggcctccacttgatgatttttctccacctgccctggtagccaaagacaaaagacataatctcttgggagctccatggccccactcatcacctgagaatcctgagtacttatccaggcaaccttaaagcaagcttgtatacccctatactatgcagttgatctctcctgaaagtgccacctcctggctagaggccaaccaactcaagccattacagcaactcataaaagaacaaacccactccaaagaagaagaaaacaacagctaattccactgcctgtagcatcctagctaaccagaggtcctgagtctgtccatgtgacaacttcactgctaacacaactagcattgagaaaaccagaacaataaacaaaattacaaccaaggacactcacggagtccacttcacccctctgctacctccactggagtagctgctggtatccacagctgagagaactgaaaatggatcacatcacaggactctttgcagacactccccagtaccagcccagagccaagtagctccactgggtggctagacccagaagagaaataacaatcacagcagtcaggctgtcaggaagccccattcctagaggaaggggaagaacaccacatcaagagagcaccctgtgggacaaaagaatctgaatagcagctctttagccccagatcattcctctgacatattctacccaaatgagaagaaaccaaaaagacaactctgctaatatgacaaaacaaggaccattaacacccccaaagatcacattagctcatcagcaatggatccaaatcaagaagaaatctctcaattgccaggaaaataattcagaaggtcacctaacacataaggactcacataaacttaaggaaaaggggtggaaagagatattccatgcaaacagacaccaaaagcgagcaggagtagctattcttacataaggtaaaacagactttgaagcaacaaaagttttaaaaaacaaagagggacattatgtaatgataaaaggactagtccaacaggaaaatatcacaatccaaaatatatatgcagaagttcccaaatttataaagcaattactactagacctaagaaatgagacagacagcaacacaatattagtggaggacttcaatactccactgacagcactagacaggtcatcaagttagaaagtcaacaaagaaacaatgaacttaaactatatcctataataaatggacttaacagatatttgcagaacattttctatccaacaactgcagaatatacattctatccatcatcacatggaacattttccaagatagaccatatatgataggccacaaaacaaagctcaataaatttaacaaaactgaaattatatcaagtgctctctcataccacagtgcaataaaattggaacaaaaggaaccttcaaaaccatggaaatacatggaaatgaaataatctactcctgaataatcattgggtcaacaatgaaatcaaaatggaaatttaaaaattcttcgaactgaacaataatagtgacacatcctatcaaacctctgggatacagcaaaagtggtgctaaaaggaaagttcatagcattaaatgcctacatcaaagagtctgaaagagcacatatagacaatctaaggtcacacttcaaggaactagagaaagaagaacaagccaaacccaaacccagcagaagaaaagaaataaccaagatcagagtagaactaattgatattgaaacaacaacaacaaaaatacaaaagataaatgacatgaaaagctggttcttggaaaagataaacaaatcaatagatcattagtgagtgtattagtcccttttcatgctgctgataaagacatacccgagaatgggtaatttattaaaaaataaaaaaaaaggtttaattgactcacagtttcatctgactggggaggcctaacaatcatggcagaaggtgacatacacgtcatacatggcagcagacatgagagaaagagaatcaagtgaaaggggtttccccttatgtaaccaccaggtctcgtgagacttatacactaccatgagaacagtatgagagaaactgcccccattattcaattatcacctactgggtccctcccacaacatgtggaaattatggaagctacaattcaagatgagatttgggtggggacacagccaaatcatatcagcgagattaaccaagaaaagagagaatatccaaataagctcaattagaaatgaaatgggagatattacaatagatatcacagaaatagaaaagatcattcaagactacttgaacacctatatgctcacaaagtagaaaaacctagaggagatagataaattcctggaaatatacaaccatcctagattaaaccaggaagcaatagaaactctgagcagatcaataacaagcagtgagattaaaatgataataacaaatcgcaaacaaaagatgttccaggaccagaggaattcaccgctgaattctatcagacattcaaggaaaaactggtaccaatcctattaacattattccaaaagataaacagggaatcctccctaaatcattctatgaagccagtatcaccctaataccaaaaccagaaaagggtatttgaaacaaaagaaaacaaaaaaccaatatcccttatgaacatagatgcaaaaatcctcaacaaaatactagttaactgaatccaaaagcacatcaaaaaggtaatccaccatgatcaagtgggtttcataccagggatgcagggatggttcaacatacacaaataaatgtgatacatcatataaacagaattaaaaacatcatctcaatagacacagaaaaagcatttgacaaaatccagtatccctttatggttaaaatcctcagtaaaattggcatagaagggacatatcttaaggtaataaaatccatctaagacaaacccacagccaatattatactgaatggggaaaaagtgagagcattccccctgagacctgggataacacaaggatgcccactctcaccaattctattcaacatagtactagaaatcctagccagagcaatcagacaaggcacagaaataaagggtatccaactcagtaaagaagaagtcaaactgtcactggtcaccaatgatatgatcatatacctagaaaagtataaagactgatccaaaaagctcctagaactgaaaaaatgaattcagcaaaggatcaagtgacaaaatcaatatatacaaatcagtagcactgctatacaccaacagtgaccaagctgagaatcaaatcaagaactcaactccttttacaacagctgcaaaaaaaaaaaaaaaaagggaaaaagaaatacttaggaatacatctaaccaaagaggtgaaagatctctacaaggaaaactacaaaacactgctgaaagaaatcatagatgacacaaacaactggaaatacatcacatgctcatgaatgggtagtatcaatattgtaaaaatgacaaatctacaaattcaccaaactagaaaaaacaatcctaaaatttatatggagtcaaaaaagagcctgcatagccagagcaagactactccaaaagaataaatctggaagcatcacattacttaacttcaaactatactataaatctgtagtcaccaaaacagcttggtacaggtattaaaaataggcacacaggccaatggaacagagtagagaacccagaaataaagccaaatacatgccggcttgatcttcaacaaagcaaacaaaaatataatgtggggaaaagatatcctattcaacaaatagtgctgggataattggcaagccacatgtagaagaatgaaactggatcctcatctctcaccttatacaaaaatcaacccaagacgaatcaaagacttaaatctaacacctgaaaccatcaaaattctagaagataatactggaaaaacccttccagaaattggcttaggcaaagaattcatgaacaagaacccaaaagcaactgcaacaaaaacagagataaatagataagactcaaactaaaaagtttctgcacagcaaaagaaataatcagcagagtaaacagacaacccacagagtgggagaaaatcatcacaaactatgcatctaactatataaacaaaggactaatatccagaatctacaaggaactcaaacaaatcagcaggaaaaaacaaacagtcccatcaaaaagtgggctaaggacatgaatagacaattctcaaaagaagatacacaaatcaccaacaaacatatgaaaaatgctcaacatcactaatgatcagggaaatataaaccaaaatcacaatgcaatatcaccttactcccagaagaatggccataattaaaaaattaaaacataatagatgttggcatggatgtggtgacaaagggaacacttttacactgctggtggaaactgctagtacagctactatggaaaacagtgtggaaagtccttaaagaactaaaagtagatctaccgtttgatccagcaatcccacttctgggtatctaccccgtgaaaaagaagtcattatatgaaaaagacatttgcacatgcatgtttatagcagcacaactggcaattgcaaaaatatggaaccagcccaaatgcccatcaatcaacaagtggataaagaaaacgtggggtgtgtttatgtgtgtgtgtgtgtatacatatatatatatacacacacacacatatatacacaatggaatactactcagccataaaaaggaatgaaataatggaattcacagcaacctggatggagttggagaccattaccttgagtgaagtaactcagaaatggaaaccaaacattgtatgttctcacttacaaatgggagctaagctatgaagatacaaaggcataagaatgatacaatggactttggggactccagggtaaggggtggggattgaaagataaaagactatgcattgggtacagtgtacactgtttggatgataggtgcaccaaaatctcacaaatcaccactaaagaacttatccatgtaagcaaacacctatttcccaaaaagctattgaaataatacataaaataatagtaattttaaaaataagcagaagaccattagtcagaggctgtctctgcactatgagttgctacatgatgaaccataacctaatttggtatgtaaacaaaccaaaatgtaacttaggagtataacagccaagtttcagctaatcacaagcagccaggtttcagtcaattataggcagccagcttttcacaacatgcccaaataaggcaaaagccttatcacactatgcccaaataatataaatacctcattgtagccaatcagatggtttctcgactttgcttccatgttgaaccaataaaagctcactgctcatgctgctgggcagagctctctgaacctcttctggttctgagtgctgcctgattcctgaattggtctttgttcaattaagctacattaaatttaaattgtcttaagtttttcttgtaataaaactatgaatcaagaatcctattaccaagcaagatatcactcacatgtaagaaaataagtatgacaattatagacatgtaagggttcatttacattatttaaaaattactctaaaaagcattttaagtaactcaaaccacttcacacatactatgaaaaccttagaacagtatactttcatttcctcctatcatttttgtgctgttgttgccatatattttaagtgtacatgttagaaatcacacaatacattttattatttttactgtacacagaagattttaatctcctttaagaagattaaaaacaatgagacaaatttctcttacatttatgcacctatttatcattgtggaacctttcattttttggtagagcaaactttccatctgatatcatttttgccttttgcctggataacttcctttaatctttctatgagaaagatgtgtttacagtgaattctgtctgtgtttgtctgaaaagcttttaccctaccttcacttatgaaatataatttaaatgcaaataaaattataacttgatagttttttcttttagtgttttaaagatatcatttcatcacttcagactcacagagtttataagaaaaagtctggttttattcttttatacatagtactctggtaagtaatataccttttttctctggctgcttttaggattcttctttacatcactgattttcaataattttattttaaatatgactcaatgtggctcctttaagtttattttgcatacagtttattcaacttattggatctgtgggcttagagtttccatcaaatgttgaaaattttcaaacattattttctcaactaatttttctactttcttccctccctttcaggatgtcagttacacatagcttagtggctgagttggtcactgctcactgatgctctgttctattttttttcaatccttcttctttctgtacttcattttagtttctattgctagatcctcaagttcactaatcttttctgcttcagtcctatctctgttattaatctcatctagtacacttttcatttcagctatcatattcattatctccagaagttccacttgagtcatttttttcttacacttctctcctcatgctcatgtatccctttatgtgcttgagcattttataacactgttttatatatacataatataacagctattttgtaaacagctttgctgctaaatctattgtctctgtttctactgatttatttatttttctccaggttatggcttctttacacacaaaataattttttactgtttggtgaacattgtgaattttacattgttaggtgccagattttgttatattctttataaccaggacatagttaattaatatgcagatcagtttcattactttgaggcttcctttaaactttgttaggataattccagaacaatcttttttcaaggccacattatccccattattaaggagagactcttctgagtactcttccagtgccttgtatcttacaatttaggtctcttcttttcactgttgggaatataaaacattccccactctgtgggagctctgagaaccgctgagtattgcttttcagtgggtccttccccagcctcactgtgtgcagttcccacctctccaataccctgagctacaaatcctagcaaattcaagctacctgaaatctaaactctgtctcctcatcaagaactctctccctgctttgtagtctataaaccaccttcaaacacataggtgggtaattgtaaggctcacctcatttgtttctcttatctcagaatttacagacatgtatcgcctaatggccaacaactgaaaacatctgttttatatactgtgtccatttttctagttctttacagtggaaaggatattcccaaaataacaaatgcctcttgatgagagactgatcgttttcggaaaatatcaatataaagaaaaaaggcaccaaggactgtgtctcaagcctgtaatcctagcactttaagaggctgaagtgggaagatcacttgaggccaggagttcgagaccagcctgggcaacataacaagacttggtctctagaaaaaaacatagccaagtatagtggtgcacacctgtagtccaaactacttagaactacttagaaggctgaggtggaaggattgcttgagcccaggagtccaaggctgcagtgagctatgattgcaccatcacaatccagcctgggtgacagactgagatactgtctctaaaataataataataattacatgagcaagtgctaaatttaaaaaaaaaaaaagagagaaaatgcaagttacaaaagttgtgaatttcttacaagtaatatattttaagggttccattgtgtataaaaaaattacctatgtgatcttggactagttatttagactttttagccctaaaatcatctcaattcaaattttcctcaaactgaagaaattttcttcccccaattcacaatcctctacttcctcatcttcaatgttcctacattacactattgtaaatatcccctatttgatattttggtttctagttttaaactattcaaatccatctttcactctaccactagattattctatttaaaacacaaaacatgtcttattcatgtttgaattcctaataattagactggattgttaagacaaatctctctaagaagatctcttttaagatgaaaccaggctaacaattagagccagccatgtagagattaagaaccaggcagagggatcaaataatgcaaagaagaatacaagagtaagcttagtgcgtgtggcaggcagaattttaagatggctctaagattcctactctctgatttacacaccctgtatattaatcctcccctcacatgtcagctcaatctgtgaataatatgcaacatcactcttgtgattatgttatgttacctggccaaagaagttatgtagatgtaatcaagctgggttagctcaagttaatcaaaagggagagtatcctggctgagccagacctgatcaggtaaggatcaggtctgctcacctgaggtcagaaaaattcatctgctggctttaagaaagttagcagtcatgcactgagacagccatgtggctagaatctgagaccagcctcaagttgaaagcaactctcctccaatagtctacaagacaatagaggcctcagttctacaacctcagaagtgaatttaaccaaaaacacatgagcctggcagagaacaactgaacttcagaggagaccacagtcttaaaagacaacttgattgcagccttgtgagaccatgtacagaggacctgttattagtccattctcacaatgctatcaagaaatacccaagaatcgataatttataaaggaaagaggtttaattgcctcacagttccccattgctagggaggcctcaggaaacttacaatcatggtggaaggcaaaggagaagctggcactttcttcacagggcggcaggacagagtgagtgcaagcagggaaatgccagatgcttaaaaagccatcagatctcatgagaactcactcactatcatgagaacagcataggggaaaccgccgccataatctaattacctccacctggtcccaatcttcactcatggggattatggggattaaaattcaaggtgagatctggatggggacacagaggcaaattatatcattccacccctggcccctcccaaatctcatgtcttttcacacttcaaaaccaatcatgccttcccaacagtaccctaaagtcttaactcatttcagcactaattgaaaagtccacagtccaaagtctcatctgagacaaggcaagtcccttccacctataagcctgtaaaatcgaaagcaagttagttacttcctagatacaatgagggcacacacattgggtaaatatagccattccaaatgggagaaaaaggagctacaggccccatgcaagtctgaaatccaatggggcaatcaaatcttaaagttccaaaataatctccttttgactccacgtctcacatctgggtcacactgatgcaagaggtggtctcccatggccttaggcagctccacccctgtggctctgcagggtacagcccccatactggctgcttccacaggctggtgttgagtgtctgccggttttccaggtgcacagtgcaagctgtaagtggatctatgattccgaggtttggaggatggtgaccctcttcttgcagctccactaggcactgccccagtgggaactctgtgtggaggcttcaaccccacattttccttccctactgacctagcagagggtcttcataagggctctgcccctgtagcaaacttctgcatggacatccaggcatttccctacatcctctgaaatctatgcagagattctcaaacctcaattcttgacttctgtgcacccataggctcaacactatgtggaagacaccaaggcttggggcttgcaccctctgaagcaatggaccaagctgtacctttgccccttttagccatggctggagctgaagcagctgcgatgcaaggcaccatgttccaaggctgcacagagcaggagggccctgagcccaccctacaaaaccatacttcctcccaggcctctggacctgtgatgggagggccttctatgaacgtctctgatatgccctggagacttcctccccattgtgttagtgactgacattcagctcctcactacgtatgcaaatttctgcatcaggcttgaatttctccccagcaaatggtttttcttttctattgcattgtcaggctgcaaatttttcaaacttttatgctctacttcctcttgaacactttgctgcttagaaatttcttccatcagataccctaaatcatctttctcaagttcaaagttccacagatctctagggcaggagcaaaatgctgccagtctctttgctaaagcatagcaagagtgacctttactctagttctcaacaaattcctcatctccatctgagaccacctcagcctggatttcattgtccatatcactatgagcattttgatcaaagccattcaataagtctctaggaagttccaaactttcccacattttccagtcttctgagccctccaaactgttccaacctctgccaaagttccaaagttgcgtccaaattttcaagtatccttgtagcagtgccccactctcagtaccaatttaggacccagttaagctatgcctgaactcctgacacacagaaactgagataacaaatgggtgttttttaaatcatgaagtgtgtagtaatctgttacacagcaatagaaaactcatggaatatgtttaagaggcaagaacaacaaaagccagtacaactggggtatggtgggcattttaagataaaaaatgggataaattgttaggagattaggttggcgagatagatgagagtcaaattctgtgaaaatttgttgttaaaagtgggaagttttttataattttgcttgttaagtatataagaaagtcatcactgagatttaagcatgggaagaacctgattggcaatttttaaagaacattctggatgctgtgagtaaaatggattgtaggaggggaataacagaagaaggaatgagactagttagaaggctgttacaataatccggtgagaattgaagaaggctgggatagtggcaaaagaagttagatgtggtcagatagcggtcatattttttaaagtggagttaacaggaattattaatggatcaggttgagggtaagaaaaagagatgaggcccagcgcagtggctcatgcctgtaatcccagcactttgggaggctgaggtgggaggatcacttgaggtcaggagttcaagaccagcctgggcaacatggtgaaatcctgtctctactaaaaatacaaaaattagctgggcatggtggtgcatgcctgtggtcccagctactctggaggctgaagcaggagaattgcttaaacccaggaggcagaggttgcagcaagctgagatcgcaccactgcactccagcctgggtgacagagcaagattctgtcaaaaaaaaaaaaaaaaggaaaagaaaaagaaatgaatcagggatgactttaagtttttgacttgacgaactaagctgatggtgggttgtcgtttattaagcaggggaagtctatgggaggaaccagttggaatgacgggatggggaaaagcatgtgttctacttcggataagttgttttaactgcctactcatcacctgaatggtgatatcaggttagcagatggttatacatgtctcaaactgcaggcacaattcagaactagaagtaacagagtcattggcatgtaggcagtatgtaaagcaaaagtactggatgtattactttgggcaagtgtgttaattgaaaatacaaggttttctgtgcctaatccctggaaaatacaactgacatatttgaggtacagcagaggaagaggagtttgcaaaggagacttaaaaagagcagtcaaggagggaagaataaggaaaaatagtataaagtcatttaaacaaacagaagaatgtatttcaagaaagagaaaacaatcacactttatcaaataatgctgaaaggaaaaaaataaaatacattaggtcagagaagtgatcattggattcataatcatggatatttaaatggtagacttaacaaaagaactgttggagtactggttgtgatggactgcccattaaagcagagacaggacaaaatctaagtgtaaaaaaaccagaaacaataatgacagtagatatctctttcaaaatatgtcactgtgaaagggttcagagattgaagctattgtgttgtgacagctggggtcaagagattttgttttgtatggttggcggtaagatgggatatatcacagcatgtttttagaaagtacattggtatccagcatactattgcaataaaattaaagctgaccttatctgattctacctaactgaattttaatgctaaataaagccaaaactttagccagttcaggatagtcatcatatacatgatggcaaaatgaatgttaaaaaataaacaactacattgagagaagataccaggcatccagagttattcataagttaaatgactggttcctacacactggtctttcaacaaatattttttggactttttttttttttttttgagatggaatctcgctctgtcacccaggctggagtgcagtggcgcgatctcagctcactgcaagctctgcctcccgggttcacgccattctcctgcctcagcctcccgagtagctaggactacagatgcgtgccaacatgcctggctagtttttgtatttttagtagagacatggtttcactattttggccaggctggtctcgaacttctgacctcatgatctgcccacctcagcctcccaaagtgctgggattacaggcgtgagccaccatgcccagcccttttttggacatttttattcaaagttgtgagtaccaataattttctataaaagcattagaattgtcagactatgagatgggcacggtggctcacacctgtaatcccagcactttgggaggctgaggtgggcagatcactgtgtgtggtcaggagttcgagaccagcctggccaacatggtgaaaccctgcctctattaaaaatacaaaaattagctaggcacagtggtaggtacctgtaatcccagctactcaggagtctgaggcagaagaatcgcttgaacccgggaggtggaggttgcagtaagctgagatcatgccactacactccagcctgggtgacagagtgagacttcatctaaaaaaaaaaaaaaagaattgtcagactatggatggacttaccctctattttccaaccatctgtaatatttctatatggagtttcaacaaaaagtaatgacattaaacatgatactgtaaaagataaataaaacctcagctgaccaaagcatcataaatgtaatatcttaaaataataagagcataattatattaagacctacagaattatccatgtctagtgaaacataaagtaacaattttaagactaaaattgtaaagagttaatggttttcaacaaacacataccaaaaattaataattaatttttaatccatagaattttagaccataaaaagatcttacatgttattttgctcaacctattcctagtgccaaacttctttcttcagcatctctgggaaatctatgcttcagcttgaaaatgtccactaagaagctcatgctttctcaaggcaagtacagtggaacagctttcatatattaagctaaaacctgcctctcccaaacttccactcattaatcttagttttgtccttggaatgcatacttagaaagctctgaaattaaaggaacagggtctttacaaagcaaactgtttgctttcaaacttttgttactaggaatatctcaaagtgggggggaaatagtgcttctgtgcttaacaaatgagctctgtttataatcaaaaaagtaaggtttacataaattatttattatcaggaaatccctaaattcagaagtagcctatagaagttgacgttttaacaaattactaaaatcagcttttgttttgttatctgatgtggtcaaagtgttatgcatggctagatacaaatatagcaaaacttcaaactcacttcctcttttcttctaatttaatatttactgattaaatcaaattttaatatgcacttgcttctgcagtagaacagatatctcataaagacaaaactcccactgaacgtagtggtagtcatcagtgctcacagtctaatgtgcactgcaaaaacatgtagagaaaaatccattaaactacattggctattgattcttttctcctgagaagttccagccagaattcattgctatcactgtcttatgcatggtggtgcctcactaatgaaagattcagatttttttaaagggtctacctggcctaaataagatatgccacttaaaattagattcataataaaccaaacaccgcatgttctcacttacaaataggagctgaacaatgagaatacacggacacagggaggggaacaacactcactggggcctgtcgggggagggttgggggagacagagcatcatgataaagagctaatgcatgcagggcttaatacccaggtgatgggttgataggtacagcaaaccaccatggcatatgtttacctatgtaacaaacctgcacatcctgcacatgtatcccagaacttaaaataaaataaaacttttttaaaagatggtaacaatagacactggggactactagagcgcggagggtggaaggggagcaagcatttaaaaactacctactgggcactatgctcactacctgggtggagggatcacttgtaccccaaaactcagcaaagcacaacatacccatgtaacaaacctgcacatgtaccccttgaatctaaaataaaagttgaaataaaaaataaattaaaaagagaaattttttttaagtagattcataaatttcacaatttataaattaatacatatatggttcgttgttcatctcatgataaaatcacttggaaaaactccaaatgtcattaggaagatacctataagatgatgtagagtcattttatggagtctacgatatattgttaagtgaaaaacaaaagcttcatatcattcctactcgatttcaaggtgtactataaagctacaataatcaagacagtgtggtattggtgaaagaatagacaaacatattagtggaacagaataaaatccaaaaataaacacataccaatacgctcaagagatctttgacaaagtagcaaagcaagtcaatgtagatagcgtttcaacaaatggtgctggaacaactgaacatccacatgtaaaaaaaaaaattagacacaggtcttacacttttcacaaattaattcaaaatggatcataagcctaaatgtaaaatgaaaagctataaaacttctagaagataacaggaaaaaaatctagatagtgttgggtttggcaataacattttaggtgcaacactgaaaacatgatatataaaataaaaattgataaattagacttcatttaaacttaaattgaaaaattctgctctgtgaaagatactcttaagagaatgaaaggacaagccacagacttggagaagatcttggcaaaacacatatctgataaaggactggtattcaaaatatacaaagaacacttaaaatacaacataagaaaacaaataacccaatttttaaaatgggcaaaagatcttaacagctacttcaccaaagaagatatacagatgccaaataattgcatgaaaagatgcgaataccatatgtcactagagaactgcaaactaaaacaacaatgacataccactacgcatctaccagaatgactaacatataaaacactgacaacaccaaatgctggtgaggatgtggagcaacaggaactctcattcattactgtggaagtgcaaaatggtacagccactttagaaaacagtttggaagtttcttacaagctaagcacaatcctaccatgtggtctagtcatcacactggatttatttcatttgagaatttatccaaatgaaaataaacccacagaaaaatctgcacaggaatgtttatagcagctttattcataattacccaaacttggaagcaactaaaatgtctttcagtcagtggaacagataaacaaactgtggtatatccatgcaatgaaaaattattcagtggtgaaatgaaataagctttcaaagcatgaaaagacataaagaaaccttaaatttatattactaagtaaaataatccagtctgaaaaggctacttactgtataatttcaactatatgacattctgaaaaggcaaaactatggagacaatgaaaagatcagtggttgccaaagttctgggggataaagcaagggatgaataaggagaccacaaaaggtttttagggtagtgaaactattctatatgttactgtaactgtggctacatgacattatggatttgtcaagagccacagaactgcacaacacaaagagtaaaaccctatataaacaatgaactttagttaataataatgtatcaatatcagttgaacaattttaacaaatataccacattaatgtaagatgttaataacaggagaaatgggagaggtagcaggtatatgggaactctgtactttctgctaaacttttctgtaaacctaaatttactctaaaaagtaaagtctattaatttttttaaatctataagcaaaaatgtatgcatacatagcatgcttttgattaagaaaaacggggcagaaaacataggaaggataaaccagaaaaacgttagattacctatatggggtgggtagaaagagcagaaggtataggaaagaggtaggatttctctgagtatacctgtttatatagttttgatgacatattaatattttatataataaaaacaaaactaaatcaacaagaatgttgtggaaagtccttataatttgctaaaaacaaaaacatataaacctaattatatatcaaatagataactatatagaataaaataaaaacaaattaatccaagaacgttttgaatacaatactgtttccaccctcagtggaaatattctaaggaccaaaataaccgcaaataaaccttgaatttcacttggtaaatttggtggcattgctggtattgtacagcaatttaagtgtgtgtgtgtccgtgtgtgcatgtgtgttgcacaagcacatgtacatgtgttaaaaatgagtaaataggcggttacactgacactattgggaactgggattttcaccatgaaagaaaggaaatacaaatatggattgaggaacagacagaatttgtggctgaagagaataaatccatgacttaagaaaaaaaaatgctttctaccattacctactaaaaggttcccgaagcaataacactctacagcaaacaataagttcctttgctatatatttaagcctcgggtttatgaatctaacattgcgtcttatctgtagttgggacatgctgtttcattcttggaaaatttctttttcctcttttttacctgcttaatgcttactcattcttaatgtttcagctaaatatgactatttctggaatataataaattaccatcgatttctctccttaaggcctatgatgacttcacactacttaatagatatccagatatacacactctgcccatggttttctttatcagattgtgctggactatcttatctagcttgttttcttcctactgctgttctgtgtgtgtgtgtgggtgtgcacgcacgtgcgcaagcacatgtgcgtgctctttattagctctaacagattttcttatttttcaaatttattcattcacttattttttcattcattcagattcattcaatgacacaggcagtgtgccagtgagtctcccaagttccattctatacttgggaacatttcattgcccccctgccacccacttcacacagacacatacgtgtgtgtgcatgtgtgcacatgtgcacacacactgctgaaattctacttctgtaaattcttcaattaatggaagagaagtcaccatttttccatgtgttttttctttctaaaattgtgccatccatgaatctaccattcaaataacagtgattcttttcataaataattacttacttaatttatgttttgctcagctctatctcttcagtgctgactttcttaagctataaaatcctggagagtaaaaatatatgccttttcatcccctttgcccttagtccagcacctgagaagccgttaagaaataccaacaataataatgcattatgcacagtggttgcacaataaatattgacagaatgaaaacaatacccttaataaatgtgaaagaacagagtcttcttgtattgctgttttaaatatcccgtaacttctggtcaaatctccttacttgctaaacgatacaaaaattaagtaatttgtaagacttgctcaagattttatacttcaggatagagtgtatattcatcaatgcaagtaactaaaatgtagaagagtaaaatgaattttgataaagttattccattttaatttcaacacacaggtgctggcactgataaatgtaacctgaaggtttaattcagagaaatctttgccttcaagcatatttaaaataagctgtttgcattttcctgcatataattattctaaccctgaaagcaccttttaaatatggattacaaatccagctgccttaaaatgaaagtaaaaggttttcctttctcagtctattttgtaagttggaaattaatgtaacagaactattttgagcttagagagttaaaccttctgactaaattcatgcttaattttttaatgtatttgtgagtttaccaaggtttgcacagaagacaacttttaaaatatcaaaaaaattaacaatgcttcatttttttaacattgtaatttttaaaattagtcatctctcctcctagagggatacttcacaaaagaggcatcccttgatcaggcagggtttactcagccaagtgcttggaatgaacccagaggaaccaaaagccctgatatttctggtatttatttgcaagaaacagtagtctccccatacccataggggtgagttccaagacccccagtgaatgcctgaaactgaggatagtacccaatccaactgccatcaataggaacatgcttcttttcatgtattctactcacaaactgaaagcctttgccatattgactaaggatttattacacactgtggctgtaccttttgcagtttgaggtgcaacaacaaagcgagcacgaattttttttccttctttacaatttcatgaatggaagtctcatccctaccatagatcttagcaacctcagcacataatattttttttctttattgagaactttcaccttttcacttaaagcactttacagcttctccttagcatatcccaattgccagcatcattacttttgtagtggtaccacaggtaactgaaaccacgaaagtgaaaccctggataaaggggaactactgtattcccattctaattgctaggatcctgttcctaactggaaactaactttagaatatgctagagaatttatgttctgcaattcaataaaacatgtgattgcccttgacagtctcaggtcattgacttgaagcagaaagttttgcttaatgactacagagcagtcttccaatccccacctgctgaactggtgcttatctcttacttgtaatatcttgtaaggaatgcaagaaacctacaaactctactattctgattatttctacaaaggtgacctttggtgagtacgtggtctaagtcccaagaaacaacacattatagtttaactttgttaccacacttcaataattgtttctcaacctggtatatagaaattctaaccaggctcctgatccattttgcctatttcatatcttagaatctcttggttgtgccaccacttcctgacaccagttgagacactttggggttgcaagtgggtttgcactttggggttgcaaaatccaactcaaactagcttaatcataaactggaatgtattatctcttggaatccagggaaatgctaaacaatagtatatagatgagcctcaataaaaatgaaccaacaacagatatgctgctgctgctttttttaaatcttgtatttttttatttttatgggtacatagtaggtgtatatatttatgaggtacatgagatacttttatacaagcatacaatgtgtaataatcacatcagggtaaacgaggtatccaccacttcaaacattcatcatttctttgtgctacaaacattccaattgtattccctcagttattcacaaatgtacaacatattattgccgactacagacaccctgttgtgctattaaatactagatcttattcattgtatctaaccatattcttatactcattaatcatttccccatccccgcccccaacactaccctttcccagcctctggtcaccatcattttactctctgtccccataagttcaattgttttgatttttagatcccacaaatgagtgagaacatgcaaagtttgtctttctgtgcctggcttatttgactttatataacgtcctctagttccatccatgttgttgcaaatgataggatctcactttttatgtctgcatagaactccatcatgtatatgtgccacattttctttatccattcatctgttgatggacacttaggttgcttccaaatcttggctattatgaatagtgctgctgtaaacatgggagtgcaggtatctctttgatatactgatttcctttcttttgagtttatatctagcagtgggattgctggatcatatggtagttctatttttagttttttgaggaacctccatattgtcttccatagtggctgtactaatttacattcccaccaatggtgtatgagttttcccttttctccacatccttgcctgcatttgttattgcttgtctttttaataaaagccattttaactggggtgagaggatatctcattgcggatttatttgcatttatctgatgatcaatgatgttgagcaccttttcatatacctgttggccatttgtatgtcttcttttgagaaatgtctattcagatcttttgcccatttttaaatcagattgttgtatctttttcctgttgagttgtttgagttccttatacactctagttattaatcccttgttataggggttgtctgcaaatattgtctcccattctgtgggtcatctatttactttgttgattgcttactttcctatgcagaaggttttgtttgattgccttttttttatttgagacagcgtcttgctctatcgctcaggctggagtgtagtggtacaattatggctcactgcagcctcaacttcccaagctcaagcaatcctcccacttcagcctcccaagtagctgggaccataggcatgcaccaccaaacccagctaattttttttttttttttgtagaggcagagtttccctatgttgcctaggctagaagctttttaacttgatgtgattacatttgtccatttttgctttggttgcctgtgctttggggttattactcaagaaatcttcacctagaacaatgttctagagagtttccccaatgttttcttttagtagtttcatagtttcaggtcttagatttaagtctttaatccactttcatttgatttttgcacatggtgaaagacagggtctaatttcattcttctgcatacagatatccagttttcccagcaccatttttgcaatttagatttcattctctttcattataaattttgtttctccacaaggcaagaaacataaccatcaaacatctaagttttatatcttaaagtttctttggccattaaaggaaacattgactctctttctcttgattccagttttaaatttcctgaaaataattctgattggcctgacttgaattagatcaatctgaaatattccattgttgagatggcataaagtggccaactgtcctggtttgcctgaaactaaagggtttcctgggatacaaatgcattgactctgatactactgttgattatttgtaatagtaaatgaaacatcatgtctaatgtattctgtgtgcttcaaatctttttaaaagaaactgaattaactaactggcatccattgctcttctcaaaaatgtttttatattttgactgaaacccaccatgtgttatggttatctcctttctttacgtttcagtatccctgaaacatattatcctgtttcacgcctcgtatctttacatatggtatttccacccctccctccttattcatgtgtcataatcctcttcatttaaactcagctcagacactgcttttgtgaagtcattgtgaatcctgttctcctcccctgggagagttagtcattccctgttttgttctctactcccaggatatatttctgtacttgtctcataattctgttttataatgatttatttacaaatatatctcatcactatcctataaggtatatgaggccacatctttatattcccagtgcctagcgcaaagcctggcataatggcagtatccccataaacgtttgataaatcgaaaaatctaaaataggaatattttaaatttggtttggggcatcaggtatcatgtacctattatttctatgatcagtctctgaataatagccagtatatctggcatatttgttaacatttaaattacaaatgatagcgtatcaagaataatgtgattactaaaaccagtaacgtgatttgggcctttaaagaagttaatttcaagcttgactttgctgtaggcccaaagtttataacttgttcctaaatagaagttaaatgataccaaaatagatgtataaataagaacagaaagtatgaacataatcagccctgttctctgacaggtgggttggaggctgaggatgcatcaaacagtaaggaaagtcctctgtgggctaacgtgggagggataatttggcttcctctctccacaggcagatggaggccttttccccctgcatagtttctgagaatgcaatgaggaaagatgattgggatgctcatgtggaacaagcatactatttggcttacattaaaaaatagaatgaaatgagtatccctagggagaactaacttacccaagacacttcaacatttctagactcatttctctgaaacagtctagaaatagaaatatatacacatattagactacatctagaaatgtatttgtatatgtatttctagacacacacatacatacacatacattacataatatatgcatacacatacatatacacacacacacacacaaactctctaatgaaaactgtgccaatttcaaaagtgaagctaaattatatttcagttatgctcccttgcatcacaaaatgaggctctccagcttaatattggcattcccaagccaggtcaagaaagtaggaactgataagctgtctggtataatagttctctagctaaatctctagaaaggtgctgcatctgacatttcttcaaattagaggaaatttcataagacttggtagggaaaaatatgtcagatgacagatatgtatatcttctttcacttttgcccaaaacgtcattaaaatgatagaaatatatttgtaaaggcataaagacataaagacaagcagaacaagaaaggaaactacagtaacaaaattctggatgctataaagtagttacatgacaaatgactaagcagacttgagaactggatccaaagctagccatagaaaaaactaaaaatcaacctggtaagactacagaggactcatgaattccataccagatatgtctgaaagaataggtgaataaaaaggcaaaaatagcaactatgtgaaagaatattttaaagcagttagattcccatatgcctttctcactctatagcctggtgactatccgtccctcaatcttgcaaaacactgaagatttcttctcttagaagagtaaaacagttctctaaactaatcacagtttagggtatggtaagataatgaaaataggtgattgagaaaacaggtatactggatgttgacattcctgtgtgccctctttccttaaacagccctaagaacttcccattaggagcttaaaagagggatttcctaggatgttccggtcaaaaggaaagatctaaagatgctgttgtcaagacttctccaactaaacggaccaatggaatcaacctaaagcaaagcttatagtgacaatggcatctagaagacaatatggtcattgttttaatttctctagggaatttattctcaacactagaatttcacatccagtctatgaagcaagagtgaggacagaataaagacatttgcatgaaattactgggagatgtgctgcataaaacaagaaaaggcatggcatacagaaatcaagatatccaacaaaggaaagaggcaataaaaatccccaaatgatggagaagaattgcaaggttgatacctatcagaaggagtagaaggtgaccagtccggatttaaatgaatggaaaggctcaggtgagattcttcagagacatgaagcatatagaatacctgatacacataaacatgttaagaaaagatgaatctggaattgtgttgactatatatacatagaaaatcaatcacaattaggaaagacaataattaatcctaggggaaataaaacattgtaatggaaaggaagaggaatcagggtttagcctatggatcagtaacattataaataatgtctgtcgacaaacataacaagtaaatagagaagactaatctaacccaaattttgcaattaatgtgttaaagagatagtcatggaaaacatgtgtgtgcttgtgtggggtactgttatagtaagcggtaggaaagagaggaatgccatattccatagtgggatgtcaatagataatgtctaaaactgaaacattaaaaaggagcaaaacaaatagattagagacataaagataaatacccagataactagataaaagagatgaaggtgttgggaggaagagaagaagatggttggggtactgctttttaaaataataataaataatatataaatatttgacaattcaagtaaaatcctctaaaacttatataatcttgactttatgatattatataatttacctaaattgaatgcatcaattctcacccataattactttttgtaagctcaaacattaagaatttggcaatgtcttataactcgcttctgtgttagggacctatggcagaaaaactctgaaattacccccaattatccctgtttctcatgcctttgtgtaatcccctccccttgagtggaagcagaacctctggtttgtttctagctaatagaatatgacaaagacaatggcatgttaattccatagttatgtcacataagattgtgacttccattttgcaaacataccctctgttgattctctccctttctggctttgatgaagtaagctaccatatggaaaggccatgtggtaaggaactaagggaggcttacaaactgaggctctcggtcaaggaattgaaagcattcagcaaggaactggggtcctccattgacaaaccacaaggaactgaattctgccaacagccatgtgagcttggaaccagatccttccccagtcgagccacagacgaggtcccattcctgggtgacaccttgattctagtcttgtgagagaacatgaaacacaggacccaagccatgcttgaatacctgacacacgaaactgtgagataataaatattttgcataaggcactaaatttgtggtaaaatggccacacagcaatagatgaataaaggatctaaccaaaagagaccatgatttgagcacctctccaactcaggtgttacaaaacaaagattgttgagttctgcttgtcagaggtatgaattctgactgattgcccaagcctccagtttgtttgcatcatccagctacttaagctgacactgctacacctaaggttcagcacggcaacctcagatgacttcattctgggctacgtcatccagaagtcataaaattatctcccaaatattaaagaatttaaacaaattactatctttagcagtgccaatcaaatgtcacccaagaggtaaagtaatattcacttcagtattttagagggaaaagtcataagaggtaacacataatagaaatcttctatttaataaaatgttaagagtagatgggaaaaatcaagtttttcaccctctaaaaagcatacattctaattacaacacattaaatatttaacaaatcctgagttctaggtaaatggaaaggaaatttcctttgcttttaatttagaataaaaggtgatatgtgggtggtgaaatggtgcagcttacagtgcctacattattgtacagaaagaaagggcagcagggagctagaattatagaagcaggaaaaaaatggtatgacaaccaggtaggcagcaatagccatttgactctctacctaccagctctcataggcttcgctgtcttagagttattataactatattgctaaaggaaaaaaaaagtgtggttatttgttacttagctgtccttatcacactgactcagaaatcaggtgtatgtgtgggagaattttcaaaagaaaatccacatacagctgtgaatcactcacctgaagaacaatgagccaaatgggcaatcactgagacaaactgtcacttatcaaaactctataagcaatgcggaggttaacctgggggtctgaatctgtcagtgccaagtttcttccagctgtcacaatcagacaagctgcctccatcataaaataatgcaagccaaattcaactgagtgggactcaaagaaacatctgaaattcaacaacagcagccttgccatctagactattttgtgacaaagttgatgacaaggggttggaaatgacagaatacatcagtatggaagtctctctttaatgacccgatgtcatgaatgaagcatgaaggacaagtgactaaacacatatcattcttatttaataccatattgaggactaaggctcacattatcctctacaggtactgcttggatcctgtattagtttcttttgctgctgtaacaaattaccacaaatttagtggcttaaaacaatacaaatgcattctctttcagctctggaggccagaaataaaaagtcagtttcactgggctaaagtcaaggtgccacaagggctgcctcctctagaggatctgggaataatctgtttcttgactcttccagctactagtggctatgctatgggtattcctcattggctctggctcatggccccttcctcccatcttcaaagccaacagtttagtatcttctatcattgcatttccttattctttctgtagtctattccccctctacctccctcttataaggacagttgtgattacatttagggtccacccagataacccagaattatttccatatctcaaaatcctaattcacatcacatctgcaaaggctcttttgctataaaaggtaacattcacagtttccaggaattccaacctggatatttttgggagctattattcagcataccacaggtcctgtctcataaatgttttaattggaagctgttcgtctgtggtaaagagtttattactcatatacaaagccatctaaaatacaataaatgtaaattaattagagattgaaaatcaatagtattttgactcctaaacactttattaattgttctgggaaatttttgagccatttctcttggtaaacataatgtaaaaaaactaaagagcagattttagtgggtcaatattatcttggcaatctcatgaatactgctgtgtgtgtgtgcacgcacacatgcacacataagcacacgcaagcttgtgagggtcaggagattggataaaggtatactaaaagtgaacacttaaagaattctaatgatacctgcatgctgtactcatggaatgattcacactataacaactatgggtgctggaatgtacttcagtaagcatcaggcaattttaattcaaaagactctgagcagattttgaagcagttgctctgacacctgagggtgtaaccatgtttgaaggtgtgtgggatgttgagaggagaaggaactaacttttattaaatggctactatgtttcaggtacagagttacaggttttacaaattttaatgttaattaaggctcacgacaacagatgctgcaggtattaaaagaagataataatacccagagaggattaggtaacttttccaagtttgccagctagcaagtggtatagctagacccacattttttgaaatctaaatatccataatggggttttagcatgttagagcagatataggagaggtcaagagtcaagaaaacacaatggttctttcagaagagctctggggaaaaaaggaatgagacaaggggaacaacattatcacacactgcaccagctgactatagtggtaggtcataatgactgcaaaacagtgtgctgggccccatttagtgatgacatcacaatacataactctaagcaaataatgtttctacttctgattcctatttcactgctttgaccctccatcacttacctgggcacagagtattcatggtatcacttctccccataaaatgggtttgacaaccaagcccaatttcttacttcatcctcagatgtagccttatacctttaaatgaacagagattaattgcatagattttccataatggggctcattcattttccgtattatagtatctactttctaaagctgattttactgagatctaattttccagctcatgccactatagaaatgactgttaaaaacttgatccaacaggaatctgagtcattgctacaatgggaaaacatctgtaccataaagaagacaagattgtcatttcattagaattcctcttgactttaaaccattaatctttgtcaataatgggatattcatttgcagctcactaactggaataaaactgaaagtgataccatcaagatatacataattctttgataaaaccacagctttagggtccatgcctccaaggataattaaagaaatagctgttggtgttctgagtctgcttgagtaacctatagtttatgggataaaagagatagattaagacagggcgaatccaggccaagacttcactgagatctcaagtctatgtattgtgaacatatgttttgtgggggaaatgaattaggtaagacatgtcatgaaacgaaggactgagagtcaatgtggttttttctttataataccttcagtagcaaaaattcctttccttatttataggcatcctttcatactttgcctttatcatagagaagaatatatctctggtcctttttagtcaatatctatgaacagctgaaaatacaatgaaagtaagaattgcttcccaaagttcctgtttgcatttccgtttatttacatatgttcctttagacctatatagacccaaaacaacctgagataaatgccactcataactgtatccctcaggggagcatataattaacaaaagcccatatatttgagcttaactgattaatcattttccctcaactctttccattataattcagtttgctttgtgttaattcctttttttaaataatctctcaactcctcctatcacccaggctgaaaaacccaggaatcaccaaagaccctctccctcaactcctgcagccaaagcccagtccaacagaatctatccaacttccttatttcacttttccagctctgattggatttgtatctataataaatcaaaaagaggtcaactaagaacaaaactaacatcattagaataaaatcaccttataaactggaatgcaaggtgctaatgttattacttttcattctgataaaatcaccttataaactggaatgcaccatgctaatgttattacttttatcttttttttagtttgtactgcacatcacagttttaatttttttaacttttaagttcatggttcatatgcaagtttgttatataggtaaatttgtgtgatgtgggtttattgtacagattattttgtcacccaggtactaagtctagtactcattagttatttttcctgatcctctccacccttccagcctccaccctctgataggtcccagtgtatgttgtttccctctatgacttaaacaaaatgacaaaaaagagcaaacaaccacatttaaaagtgggcaaagaacgtgaacactttcctaaagaagatatacctgtggccaacaagcatatgaaaaaaagctcaatatcaatgatcattagagaaatgcaaatcaaaaccacaatgagataccatctcgcaccaatcagaatggctattattaaaaagtcaaaaaaatagatgctgtcaaggttgcagagaaaagggaacatttatacacagttggtgggaatgtaaaattagttcaaccattgtggaagacagtgtggaaattcctcaaagatctaaagacagaaatacaattcaacccagtaatcccattactgcatatatactgagaggaatataaatcattctgtcataaagacatgcacacatgtgttcattacagcactattcacaaaagcaaagacatggaatcaaactaaatgcccatcaatgatagactggataaagaaaatatgctacctatacaccatggaatactatccagtcataaaaaataatgagatcatgtcctttgcagggacatggctggagctggaggccattatccttagcaaactaatgcaagaacagaaaaccaaacattgcctgttcgcacttacaagtgggagctgaatgatgagaatgcatggacacacagaggggaacaacatattatttttatctttacttgaaaagtatgtcttgatttcctccatataaaattcaagaccttggggatgcagacaaaataggttgtttcatgtggggtttatgataggctgaataatagccctttcaggatggctacatcctaataaccagaacctgtgaatattttaccataaacacacatcacaaatggacctatgaagctacaattaaggttcctgagagtgagagattattatggattatctggatagacccaatgtaatcacaagagtccttaaagaaggaaaaaagggtcagagtcagacaaggtaatgagaagagggcaagggccccaatagtctcaaccccttataacatacattcaaatacaaaataccatctaaatctcatcagcttaaaagtcccaaaccttatcatctaaaggatctatgggtgaggctctggatataatctatcctggagaaaaatacctctccatctgtggatctgtgaagctagaaaataagttatcagatcaaaaagtacaatggtggcacaggcataagataatcaatatagacattctcattgggagaaaatagaaggggaaaaaggggtcactattcccatgacattttgcaatccaactgggaaaattctatcatgtttcaaaacccaggaataatcctctgtggctggagggtccatcctctgggcccgtggctctgccatgacctcagagttatccttcttttcatgaagggtaatgtgtctaaacctgagttattttattagcctgttttctaactggagaattttggaagtcaaacaaacttctatcattttgttctttctctgtctctttcagtccaagctggcagtgtttctgctgatacaacattctcaaaaactttgtgggtctcccacacatgttacagggagtaaatccatcaaacaagaggctcttccacaaatatatgcaggataatcccatttttattcctggctcctattgagatctgtgaggggatccatgagtcatatacttaatcttttcaaacacttttctgtgtgattaaaatactgaccttatctaaaatcgttccaaggcacaagcaaaagactgctcagccaaacctttggcattctctccagagcatactttcttgtaatcaaatcttctaactttagcagtttttgaaagctgaatagactgagaatttcctaaattatcaagtcctagttcctttttgtttaacagttcttcccttaatctatgtctttcctctcacattttactataagaaacaagaaaccaagccacattttcaacagtttgcttggatttccaagcaaatttcctcggctaaatctccacgctcatggcttagaaattctatttcccacatgactgcagaacaaaattctgctgagtcttctgccaccaaataacaaagaacccttaattccatctgggccattatgaggagttcctttagtattcctatttctatagtttatttataatagctttaatattctctaagacaatttaatttttctctattatgttcctcacttccttctgagcccttactagcagagtccttagtatctatatttccactagcaatctgttcacagaaatctaggcttttctatcatgctcctcaacattcttccagcctcttcccactggaaatcacaaccacatttttaggtatttgttagcgcataacctcacttccaaatctatgttagcttcctacttctgctccaataaattctcactaacttagtggcttgaaacaatgcacatttatcttctttttctggaggttagaaatctaaaatagattttgaaatgtactgacatttatgagtcttacatgactaaaattaaagtgtcataatcttcattccttatggatactttagggaaggatccattccttgcctttcccagcttcaaaaggccgcccgcattccatggctcatggctacatcacttggatctccgcttctgtcatcacatctctttctctccctctgcttctgtcatggcattgctttttatgacactacccctcatgccttcttctcataagaacccttgtgatttgtctggacccacagaagtaatccaggataatctcaagaacattaacttaatcacctgtgaagccctttttgctatgtagtcatacctcattttattgtgctttgctttattgctctttgcacatattgcctttttacagattgaagttttgtcacaaccctgcatggagcaagcctatcagcaccatttttccaacagcatgtgctcacctcatggcttggtgtcacattttgataattctcacaatatttcaagttttttattattattatattttttgtggtgatttgtgatcagtgacctttgatgttactactgtaatcacttgaggcaccatgatccactatcacatagaatggtgaatttaatcaataaatgttgtatgtgttctgactgctccaccaaccagcctttgccctgtcttgttctttctccttgggcctcctagttcctgagacacaataatattgaaattagactgataaataaccctataatggcttctactgttccagtgaaaagaagagtcatacatctcattttaaatcaaaaactacaggcccagtgcagtggttctacctgtaatcccagcactttgggaagccaaggcagacagatcacttgagctcaggagttcgagaccagcctggccaacatagtgaaatcccatctctattaaaaatacaaaaaaaaaaaaaaattagctgggcatggtggcaggttcctgtaatcccagctactcgggaggctaaggcaggagaatagcttgaacctgggaggcgggggttgcaataagcagagattgcaccactgaacttcagactaggcaacagagcaagagtccatctaaaaataaaaaataataaataaataaataaaaagctacaaatgattaagcttggtgtcaggcctcgagcccaagctaagccatcatatcccctgtaacctgcacgtacacatccagatggccagttcctgccttaactgatgacattccaccataaaagaagtgaaaatggcctgttcctgccttaactgatgacattgtcttgtgaaattccttctcctggctcatcctgactcaaaagctcccctactgagcaccttgtgacccccaactcctgcccaccagagaacaattcccctttgactgtaattttcctttacctacccaaatcttataaaacggccccacccctatctcccttcgctgactcttttcggactcagcccgcctgcacccaggtgattaaaagctttattgctcacacaaagccagtttggtggtctcttcacacggatgcgcatgaaatttggtgccgtgactcggatcaggggacccttggagatcccttgggagatcaatcccctgtcctcctgctctttgctccgtgaaaaagatccacctatgacctcgggtcctcagacccatcagcccaaggaacatctcaccaattttaaatcgggtaagcagcctcttcttactctcttctccaacctctctcactatccctcaaccactttctcttttcaatcttggcaccacccttcaatctctcccttctcttaatttcaattgctttcattttctggtagaaacaaagaagacacattttatccgtggacccaaaactcaggcatcagtcacagacttgggaagccagccttcccttcatgtttaatcattgcagggacgcctctccatttacccacgtttcagaggtgtctgaccacgcagggatgcctgcctcggtccttcacccttagcagcaagtcccgcttttctgggggaggggcaaaaaccacaaccccttctctccctgtctctaccccttctctgcttttctggggtgcaagaaccccccgatcccttatttccgtgccccgacctcttatctctgtgccccgatcccttatttccatgccctgacctcttatctctgcaccccaattccttatttccatgccctgacctcttatctctgcgccccgatcccttatttccacaccccgacctcttatctctgcaccccaaccccttattttggcgccccgacacctttcccacttttctggagggtaagaacctccgaacctcttccctccatgtccctactctctcttttctctgggcttgcctccttcactatgggcaaccttccaccctccattactccttcttctcccttagcctgtgttctcaagaacttaaaacctcttcaactcacacctgacctaaaacctaaatgccttattttcttctgcaatgccgcttgaccccaatacaaactcaacagtgattccaaatagccagaaaatggcactttcaatttttccatcctacgagatctaaataattcttgtcgtaaaatgggcaaacggtctgaggtgcctgacatccaggcattctttcacacatcagtcccttcctagtctctgttcccaatgcaaatcgtcccaaatcttccttctttccctcccgcctgtcccctcagtcccaaccccaagcgtcgctgagtctttctaatcttccttttctacagacccatctgacctctcccctcctcgccaggccgagctaggtcccaattcttcctcagcctctgcttctccaccctataatccttttatcacctcccttcctcacacctggtccagcttacagtttcattccgtgactagccctcacccacctgcccagcaatttactcttaaaaaggtggctggagctaaaggcatagtcaaagttaatgctcctttttctttatcccaaatcagatagcatttaggctctttttcatcaaatataaaaactcagcccagttcatggctcgtttggcagcaaccctgagatgctttacagccctggaccctaaaaggtcaaaaggctgtcttattctcaatatacatcttattacccaatctgctcccaacattaaataaaactccaaaaattaaattccggccctcaaaccccacaacaggacttaattaacctctccttcaaggtgtacaataatagggtagaggcagccaagtagcaacatatttctgagttacaattccttgcctccactgtgagacaaaccccagccacatctccagcatacaagaacttccaaacgcctaaaccgcagtggccaggtgttcctccaggcccgcctcccccaggagcttgctacaagtgccagaaatctggccaccaggccaaggaatgcccacagcccgggattcctcctaagccgcgtcccatctgtgtgggaccccactgaaaattggactgttcaactcacctggcagccactcccagagcccctggaactctggcccaaggctctctgactgactccttcccagatcttctcggcttagtggctgaagactgacactgcccgatcgccttggaagccccctagaccatcacggacgccgagctttaagtaactctcacagtggaaggtaagtccgtccccttcttaatcaatacggaggctacccactccacattaccttcttttcaaggcctgtttcccttgcctccaaactgttgtgggtagtgacggccaggcttctaaacctcttaaaactccccaactctggtgccaacttagacaatactcttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccatgttagccaggatggtctcgatctgacctcgtgatccgcccgcctctgcttcccaaagtgctgggattacaggcgtgagccaccgcgcccagccgacaatactcttttaagcactcctttttagttatccccacctgcccagttcccttattaggccgagacatttaactaaattatctgcttccctgactattcctggactacagctgtatctcattgccacccttcttcccaatccaaagcctcctttgcgtcctcctcttgtatccccccaccttaacccacaagtataagatacctctactccctccttggcgactgatcatgcacccctcaccatctcactaaaacctaatcactcttaccccgctcaatgccgatatcccatcccacagcatgctttaaaaggattaaagcctgttatcactggcctgttacagcatgggcttttaaagcctataaactctccttacaattcccctattttacctgtcctagaaccagacaagccttacaagttagttcaggatctgcgccttatcaaccaaattgttttgcctatccaccccatggtgccaaacccatatactctcctatcttcaatacctccctcaacaacccattattctgttctggatctcaaacatgctttctttactatgcctttgcacccttcatcccagcctttcttcgctttcacttagactgaccctgacacccatcaggctcagcaaattacctgggctgtactgccacaaggcttcacagacagcccccattacttcagtcaagaccaagtttcatcctcatctgttaccaatcttggcataattcttataaaaacacacacgtgctctccctgctgattgtgtccgactaatctcccaaacctcaatcccttacaaaacaacaactcctttccttcctaggcatggttagtgcagtcagaattcttacagaagagccaggactgcaccctgtagcctttctgtccaaacaacttgaccttactgttttagcctagccctcatgtctgcgtgcagcggctgccgctgctttaatacttttagaggcccttaaaatcacaaactatgctcaactcactctctacagttctcataacttctaaaatctattttcttcctcacacctgacacatatactttctgtttcccggctccttcagctgtactcactctttgttgagtctcccacaattaccattgttcctggcccagacttcaatccagcctcccacattattcctgataccacacctgacccccatgactgtatctctctgatccacctgacattcactccattttcccatattctttcatgttcctcaccctgaacacacttggtttattgacggcagttccaccaggcctaatcgccactcaccagcaaaggcaggctatgctatagtatcttccacatctattattgaggctactgctctgcccccctccactacctctcagcaagccgaactcattgccttaagccctcactcttgcaaaagcactaaaagtcaatatttatactgactctaaatatgccttccatattctgcaccaccatgcgagaggtttcctcactacacaagggtcctctatcattaatgcctctttaataaaaacgcttctcaaagctgctttacttccaaaggaagctagagtcattcactgcaaaggccatcaaagggcatcagatcccatcgctcaggacaatgctcatactgataagatagctaaaaaagcagctagcattccaacttatacccctcactttcagtttttctccttctcatctggccactcccacctactcccccgctgaaacttccacttatcaatctcttcccacacaaggcaaatggttcttagaccaaggaacatatctccttccagcctcacaggcccattctattctgtcgtcatttcataacctcttccatgtaggttacaagccactagcccatctcttagaacctctcatttcctttccatcatagaaatctatcctcaaggaaagcacttctcagtgttctatctgctattctactacccttcagggattgttcaggcctcctccctttcccatacatcaagctcggggatttgcccctgcccaggactggcaaattgactttactcacatgccccgagtcagaaaactaaaatatctcttagtctgtgtagacactttcactggatgggtagaggcctttcctacggggtctaagaaggccaccgcagtcatttctttccttctgtcagacataattcctcagtttagccttcccacctctatacagtccaatagcagaccagcctttattagtcaaatcagccaagcagtttttcaggctcttggtattcagttaaacctttatttcccttacagtcctcagtcttcaggaaaggtagaacggactaatggtcttttaaaaacacacctcaccaatctcagccaccaacttaaaaaggactggacaatacttttacctctttcttttctcagaattcaggcctatcctcggaatgctgcaaggtacagcccattggagctcctgtatggacgctcctttttattaggccccagtctcattccagacaccagaccaacttggactgtgccccaaaaaacttgtcacccctactatcttctgtctagtcatactcctattcaccgttctcaactactcatacatgccctgctcttgtttacactgccggtttacactgtttctccaagtcatcacagccaatatctcctggtgctatcccaaactgccactcttaactcttaaagtaaataaataatctttgctggcagggctatgctgaacctccttaggcactctctaattagatgtcctgggtcctcccaattcttagacctttaatacctgcttttctctttctcttattccgttcagtttttcaattcatacaaaactatatccaggccatcaccaataattctaaatgacaaatgtttcttctaacaaccccacaatatcaccccttaccacaaaatcttccttcagcttaatatctcccactctaggttcccacgccgcccctaatcccactcgaagcagccctgagaaacatcgcccgttatctctccataccaccccccaaaattttcgtcgtcccaacactttatcactatttcattttatttttcttaatataagaagacaggaacgtcaggcctctgagcccaagctaagccatcatatcccctgtgacctgcacatacacatccagatggccggttcctgccttaactgatgacattctaccacaaaagaagtgaaaatggcctgttcctgccttaactgatgacattgtcttgtgaaattccttctcctggctcatcctgcctcaaaagctcccctactgagcaccttgtgacctcccactcctgcctgccagagaacaacccccctttgactgtaattttcctttacctatccaaatcttataaaacggccccacccctatctcccttcgctgactctcttttcggactcagcctgcctgcacccaggtgattaaaagctttattgctcacacaaagcctgtttggtggtctcttcacactgatgcgcatgaaacttggtgaagtatgtatgtcaaaagctgagataggctaaaacctaggcctcatgtgccaaacagttagtaaatgcattatgtaagaaatacatttcaagttgtgaatgcaaaggaaaagttcttgaaggaaattaaaagtgcgactccagtggacacataaatgataagaaagggaaacagcctgaatgctgatatggcaaaagttttagtgctctggaaagatcaaaccagccacaacatttacttaagccaaatgctaatccagaacaaggccctaactctcttcaattctatgaaggctgagagaggcaaagaaactgcagaagaaaattttgaagctagcaggggttcatgaggtttaaggaaagaagccatttccatgacacaaaagtgcaagaagcagcaagtgctgatggagaagctgtagcaagttatccagaagatccagctaaattgataaaggtgactacactaaacaacagattctcaatgtagatgaaacagccttctattggaagaagattccatttaggactctcataaccagagaggagaagtcaacgtctggcttcaaagcttcaaagaacaggctcactgttttgttaggttgtaatgcagctggtaactttaagttgaagccaatgctcatttgccattctgaaaacactaaagcttttaagaacgatgttaaatgtactctgcctgtgctctataataaaataataaagcctggatgacagtacatttgtttacagcacagtttactgaccattttaagcccactgttgagacctactgcttaaaaaaagattcctttcaaattattattgctcatcgacaatgcacctaattacccaagagctctgactggaggtgtacaaggagactaatgttttcatggttggtaacacaacatccattctgcagccaatggatcaagcagtaattttgactttcaagtcttatgtaagaaatacagggtgggaccaagatggccaactagccaacaagaagcagccaccgtcagaggctcccatcaaaaagaaccataatagcatgtgaatcctgcactggcaactgaggtatccaggttctctcatcagaactgactaggcagctggtgtgacctacagagagaaaggaagcgcagtggtgcagggggcccacctgagagccacacagggcaggtgggtccccacccccccgccaagggaggtgatgagtgagtgtgccatccagcctgggaaaccatgctttttccacagactgtgcaacctcctgatcagaagatctcactcatgaaatcacaacaccagggcctaggatcccaaccacagagccctgcagattctcaaaagcctctcagctagactctgcttaagcctgctgagttcccggtggggaggggcgactagcaccacagttgcggctgcctgttgtttaagccatttgagctctttgggggaggggcagcagccagcactgggactgatagctgcctaacacactaagctccctgggcaggggaagggtggcagccatctctatagctccaggctacacttttcccctgctggagccaggaaggcttggttccgagaggggtcccccgcagcacaacacaccggctgtggcagactgtggccagagtgcctcttcaggcctgacactgacccatccctcctcactgggaggggcctccctgcaggaactccaactccaggcaggggctcaggcacaaagctctgatctccctggccggagccactaggggtaggggtgaccacagtctctgaggaccagcagacttagcctttcctcctgctagttctgagaaatctgggcagcccagatgagtgggtttcccctcagcaaagcactccccctccaccaagggatagtcaaagagcttcattaaacgggtcctgctccctgtaccacccaactaggtgagaccatcaaacaggggttgtcagacatcctatacaggagtgatcatactggcatcagatcggtgctcctcgaggtcagagttcccagaggaaggaggaagcacccatctttgctgttttccagcctccttgagtgactggctccaggcacaggagcgagccagatgaatagtgcctgaagtgaatgcccagcaaaccacaacagccctacagaagaggggcctgaccattgaaagaaaaacaaacagaaagcaacaacaacagcatcagcaaaaagtgtctccccaaaaaaacccatcaaggataggcagcctcaaatatcaaaactagacaaattcatgaagatgagaaaggatcaacaaaaaaaaaaacactgaaagcccaaaaggccagagtgcctcttctcctccaaatgattgcaatgccgctccagcaagggtgcagaactgggcagaggatgagatggacaaattgacagaagtaggcttcagaaggtgggtaatatcaaattctgctagctaaaggatcatgttctaacccaatgcaaagaagctaagaaccttgaaaaaaggttacaggagctgctaactagaataaccagtttagagaggaacataaataacctgatggagctgaaaaacacagcggaagaacttcgtgaagcatacagaagtatcaatagccgaatcaaccaagaggaagaaagtatatctgagtttgaagaccaccttgctgaaataaggcatgcagacaagattagaggaaaaagaatgaaaaggaatgaacaaaacctccaagaaatataggattatgtaaaaagaccgaacctacaattgactggagtacctgaaacagacagagaaaattgaaccaagctgcaaaacacacttcaggatgttatctaggagaatgttgccaacctagcaagataggccaacattaaaattcaggaaatacagtgaacaccactaagatactccatgagacaatcaaccccaagacacataatcattagattctccaaggtcgaaaggaaggaaaaaaatgttaagggcagccagagagaaagaccaggtcacccacaaagggaagcccatcagactaacagcagacctctcagcagaaacggtacaagccagaagagagtgagggccaatattcaacagtcttagaaaaattattttcaactcagaatttcatatccagccaaactaagcttcataagcaaagaagaaataaaatcctttccagacaagcaaatactgagggatttcatcaccaccatgcctgccttacaagagcccctgagggaagcactaaatatgaaaaggaacaactggtaccagccattgcaaagacacatcaaaatataaagaccaatgacactatgaagaaactgcatcaactagtgtgcaaaataccaaggtagtatcatgatgacaggatcaaaatcacatataacaatattaaccttaaatgtaaatgggctaaatgccccagttaaaagacacagactggcaaattggataaagagtcaagacccatcagtgtgctgtatttaggagacccaactcatggtcaaagacatacataggctcaaaatgaagagatggaggcaagtttaccaagcaaatgaaaagcaaaaagaaagcaggggttgcaatcctagtctctgacaaaacagactttaaaccaacaaagataaaaaaagacaagggcattacataatggtaaagggatcaattcaacaagaagagctaactatcctaaatatgtatgcacccaatacaggagcacccaaattcataaaacaagttcttagagacctacaaagagacttagactcccacacaataataaaaagggacttctaacaccctactgtcaatattggacacatcaatgagacagaaaattaacaaggatattcaggacttaaactcagctctggatcaagtggacctaaaagagatctacagaaccctccacaccaaatcaacagaatatacattcttctcagtgcatggcatttattctcaaattgaccacaaaattggaagtaaaacacttctcagtaaatgcaaaataactgaaatcataacagcctctcagaccacagtgcaatcaaattagaactcaggattaagaaactcactcaaaaccacacaattacatggaaattgaacaacctgctcctgaaggactcctgggtaaataatgaaattaaggcagaaatcaagttatttgaaaccaataagaacaaagagacaatgtgccagaatctctgggacacagctaaagcagtgttaagagggtagcactaaatccccatatcagaaagctagaaagatctcaaatcgacaccctaacctcacaattaaaagagctagagaagcaagagcaaactaatccaaaagctagcagaagacaagaaataactaagatcagagcagaactgaaggggatagagacacaaaaaaccctcaaaaaaatcaataaatccagcagctggttttttgaaaaaattaacaaaataggtagactgctagctagactaataaagaagaaaaaagaatcaaatagacacaataaaaaacgataaaggggatattaccacttatcccacagaaatacaaactaccatcagagaatactataaacacctctatgcaaataaactagaaaatctagaagaaatggataaattcctggacacatacatcatcccaaaactaaaccaggaagaagtcgaatccataaatagaccaataacaagttctgaaattgaggcagtaattaatagtctaccaaccaagaaaagcccaggaccagaaggaatcacagccaaattctaccagccaaattctacaaagaggagctggtgccattccttctgaatatgatccaaacagtgaaaagcaggtactcttccctaactaattttatgaggccatcatcatcctgataccaaaactgggcagagacacaacaaaaaaaagaaaatttcaggccaatatccctgatgaatattgatgcaaaaatcctcaataaaatactggcaaaccgaatccagcagcacattggaaaacttatccaccacaatcaagttgacttcatccctgggatgcaaggctagttcaacatacacaaatcaatacatgtactccatcacacagacagaaccaatgacaataaccacacgattatctcaatagatgcagaaaaggcctttgataaaattcaacatgtcttcatattaaaaactctcaataaactagatattgatggaacatatctcaaaataatcagagctatttatgacaaacccacagccaatatcatattgaatgggcaaaagctggaagcattccctttgaaaactggtgcaagacaaggatgccctcactcaccactccctttcaacataatattggaaattctggccagggcaatcaggcaagagaaagaagtaaagcatattcgaatagaaagagaggaagtcatattgtccctttttgcagatgacatgattctacatttagaaaacccagcatctcagccccaaaactccttaaactgataagcaactttggcaaagtctcaagatacaaaatcaatgtgcaaaaatcacaagcattcctatacaccaacaatagacaagcagaggaccaaatcacaaatgaactcccattcacaattgctataaagagaataaaatacctaggaatacagctaacaagggatgtgaaggacctcttcaaggagaactacaaaccactgctcaaggaaatcagagaggacacaaacaaatggaaaaacattccatcctcatggataggaaaaatcaatgttgtgaaaatggccattctgcccaaagtaatttatagattcaatgctattcccatcaagctaccattgacaatcttcacagaattagaaaaaactattttaaatttcatatggaaccaaacaagagcccatatagccaggacaatcctaatcaaaaagaacaaagcaggaggcatcacactacctgacttcaaactatactacaaggctacagtaaccaaaacagcatggtactggtaccaaaacagacatatagaccagtggaacagaacggagaactcagaaataacaccacacatctacaaccatctgatctttgacaaacctgacaaaaacaaacaataggaaaagaatttcctattcaataaaaggtgctgggaaaactggctagccatatgcagaaaactgaaactggaccccttccttataccttttacagaaattaactcattaaagacttaaatgtaaaacccaaaaccataaaaaccctagacgaaaacttaggcaataccattcaggacataggcatgggcaaagacttcatgatgaaaacaccaaaagcaattccaacaaaagccaaaattgacaaatgagatctaattaaagagcttctgcacagcaaaagaaactatcatcagagtgaacaggcaacctacagaatgggagaaagtttttgccatctacccatttgacaaaggtctaatatccagaatctacaaggaacttaaacaaatttacaagaaaaaaaaatccccatcaaaaagcgggcaaaggatatgaacagacacttctcaaaagaaaacatttatgtggccaatgaacacatgaaaaaaagctcaacatcactgatcattagagaaatgcaaatcgaaactacagtgagatactgtctcatgccagtcagaatggtaattattaaaaagtcaagaaacaatagatgcttgggaggctgtggagaaataggaacacttttacactgttggtgggaatgtaaattagtccaaccattgtggacgacagtatggcaattcgtcaaggatctagaaccagaaataccatttgacccagcaaccccattactgggtatatatccaaagaattgttccattataaagacacatgcacacatattatcactgcagcactatttacaacagcaaagacatggaaccaacccaaatgcccatcaatgatagactggataaagaaaatgcggtaaatatacacgatggaatactatgcaaccataaaaagaaatgagaccttgtcctttgcagggacttggatgaagctggaagccatcctaactaactaactaacaggaacagaaaactaacacaggaagagaaaaccaaacaccgcatgttttcactcataagtgggagctaaacaatgagaacacatttagcggacaacagcatagtgtaaatacaacttttatatgcacttggcaatcaaaaaattcatgtgagttgctctactgcagtattcgctttattgcagtggtctataactgaatctgtagtacctccaagatatgcctgtgtaaagcaacatattcacagttctgtgtattacaatatgaacatctctgacatgaaaatatgcataaatttctcacattttataagaagtttttattcatctttctatttgaaagacgctttttccgagtataaaattctagatcaacagctaatttttggcaccttaaagacagtccattgtctttctgggtcacaaagctagtggtaagaagtccaccatcaccctcatctttgttcctctgtaagtaatgaagttttggagtaatgaagtagtttgtaagtaatgaagtcttgaagtttgccattttttttcttctggcaatttaaattttatagttgaggttcttagagtgaacttttcatttcagtaattgtacttttgaactccagaatttctatttgatttttttaatcatttctctctattgatattctctatttgatgcaaaattgttgtcctaccttcctttatttaatcatagtttcctttagttctttgaacatatctacaatggctactttctagtcattttctgttagtctgatttctgaccactgtctgcctactgtacttacaaagtatgggtcatattttcttgtttcttttcacgccttgtaaatttctgttggtaactggacattttaggtaatacatcatggcaactctgggtaaacccacccctgctctaagcttgttattatttgttttttgtttaatgactagctggactattttagtgatgttcactgtcatcctcatctttgattctctgtaagtaatgagtatttttccctttttgcatataagtttgtcactgtatcactagatttcagtaaactgaatatgacacaaatatgactattttccacctgcagtgttaaatctttggtgctgctcctcaaggagttgtagctttgtgcatgtatgctcacatatggtcactagtatgacagtggttttggcaggactctttttgtcactttctctgaccacgtccaactgttaagctatactaagtgccagctgatttatgtactgctttcaacaatactgtggtgcttaaattgttctatagactaatccatcaaattcgggttcctttgaaggagtagttcctacattgtttgagatttgctctgttgaggagctctgaccacagatgggctcccacaagctgtctctttccaagggtctctgcttttccctccaggcaaaatctcaagtcaagtcaagttgagtcaaggctctggaactagggtggcagacaattgcacactctctctaaatgacaccctcactttaagagctgagtgctcattgggggccagagagggtagaagatgaacagtagcctccaacttttttggctagtttcatccagagtacaacactcactttacagactaaggcaaggacaatcagaacccctatatctcagcagtgccaaacccaaggtaaagactgcatctcatgagtggggagctgtgcagaagagaactctacttcagaacttagcctcatcaataggtagctgtggcaagatgagaaaagctgatatccttccataggattactctctgtctgggagctgagaatagagagagccttgtgttttgggctgcactagtttggaataaagtttccatctcactaagctgggaaaggggataggagggaaagggtctcagttccccatagagtcttgctgttcttaccacaatacagattttctggaataaacgtttcttcatctacttattatttaaatgtccgtaagactatttccagagacattaaatggtatgttgttgggtatttttgtttttgtttttgttttgtttcttttgtttgtttgcttgtttttgagatagagtttccctctttttgcctaggctggagtgcaatgttgttatctccgctcactgcaacctccacctcccaggctcaagtgattctcctgcctcagcctccctcccaaatagctgggattacaggaatgcaccaccacacctggctaattttgttttatgtttatttgtttgtttttgagaaaatgtctcactctgtcacccagactggagtgcagtggcacgatctcggctcaccgcaacctccgcctcccaggctcaagcgattctcctgcctcagccttccaagtagctgggattagaagcgcacgccaccacacccagataatttttgtatttttagtagagacggggtttcaccacgttggccaggcttgtctcaaactcctgacctcaaatgatccactcgcctctgcctcccaaagcgctgggattataggcgtgaaccaccgtgccgtgtgtgtgtgtgtgtgtgtgtgtgtgtgtgtgtgtgtgtgtgtgttttaattatcttcaccagtttttctggagaaagagtctgctgagcttctcatgctattatgccagaagtccctcccagtcaattaacaaaagtggcaaggtaattcaatgagaatactagagtctttttcaaaaaatggttctagacaatgaatatgggaaaaatgaaactcaacctttccttataccatatgcaaaataatttggaatgaattacagcctaaaatatgagtcaaactattaaacttctagaagaaaacacaggaagaattatttgtaattttgggataggcaaagatatcttagctaagacacaaaaaacatgaatcatacacacataaaaactgtaaaactgggcttcatcaaaaatttttaaagtttgtcctttaaaagatactgtttgaaaaattaaaaggcaagccaaagactacgagaataactttaaaaccagaaatctgatgaagaacttgtttttgagatatataaagaattcgttcaactgaataataatatagacaatccaatttaaaaatgggcaaaagtttgaacagatacttcatcaaagaagatatgaaaaatggcaggtaaataaatgatgttctataatattggtagtctttaaggaaatgcaaattaaaaacataggattgcactatttacctattaaaatggctaaaacttaaaagactgatgatatatatagcaagggtacagagcaactgtaatacttatacattactgattggaacttaatacggtacagccactttggaaagcagtttggcaatttctccaaaagttaaacacagacataacatacagtgcagtaatcccactcttacatgtttacccaagagaaataaaaacacaaagacttacatgcaaagattcataactttattaattacagccaaaatctggaaacaacccaaaagtctatcaacaggcaaatggaaaaacatgttgtagtatagccttacaataaaatactactcagcaacaaaaggaatgaaaatatcagtgaaagaagccaggcacaaaagactgtatgattctatttgtatgaaattctagaaaaaaaaattatagtgatagaaaacaaatgtgtggttgcctcagggtgggactgttgtgtggaaattggccaaaggggcatgagagatctttggaagaatgatgaaaatattttatatctttattatggttttagttacattactatacatttttcaaactcacccaaatgaatcctgaatgaattttattgtatgtaaattatatctctaatttttttaaaaaggtcaatagaagcaatgtattaaatagtttaatagtagagaaagatcagaaagatcaagacagagacactgtcttcatgtatattaacgtactggatatcagagattctgaaattatgttagatatcaagtgaaaatattcttttgtcaatcattttcattcagttataagaccaacatttatcttaagccagatttgtgaaaattcaatgtaaaaataattatcatactatttcacaagagtgttattgttccttgctcattaaaaaaaaaaagagcaagagcttgttgagatgtcatagctaacaaagctataataaactgggatttttttcagcaaatgtttgcttccctttcctctttgggtcagggtatactttccactcccactgcctttatgcttggccatgcgacttgccttggccaatggaatatgagcatgcaggatatctgcagaattttaaatgtgtttgcctggcttagcttgcacttgaactcctataatcaacatacaattacaacataggcaaccagtgcctcgttaggctggatcaaagcgtgaagcttaaggggcaaacctgaacttacctcaaagcctgaaactgaactacagcataaagcagagccacttatgagtgagaaaattaaaagcttgccatgatacgacaataaatttggtggaggtttgttacagcattattatggcaagagttgactcatgcaaagctaacatttgaggagaaattacaatgttctaggcactgagctacaaactttacatatattacccatttaattatcacaatgactctgtaagagaaaacattttacattgtctttctaaaatacatgatgaaactgaagcacaaataggataattgcattatccaaagtctcagagctagtaagtaaccaagtagggtttaaacccaggatgttataattctaatactcacccaatgcactaattatcaagatcaaattgaatttttaaattctattcttctagttggggtgttaaataatggttaacactcttcaatctccataaacccttttcttctcttccacctaacctgcccatcttcatacctgtatctaaacaaccatctgtttactgtaccccaactattgggttgtcagtagctagaaaagtacgctgccttgactccattacaaggttagctgatggactttccatatagctttgcaaaattgtgcttattcatgttgattccattttgcattccccacaatagctgttccaaaccttaatcaccaagataagccctaatttcaatatcactcctcactctcagaggctctgcctccaatttctcagcgaatgaatattccatgaggcattacatttctcaacttttttcctctctgccttatacctatctttacctctctttactccttgctcttgtgtctcaaatgactaattctacccccatattcttgtctttcttccttcccataccttgttctacagatttaacatcttcctttttttctctctactagaaaacctacatactcatttctcccacatctttttttgctcttgttgcccaggctggagtgcaatggcatgatctcagctcactgcaatctccacctcccgggttcaagcaactctcctgcctcagcacccccgagtagctgggattacaggcatgcgccaccacgcatggctaatttttgtatttttagtagaaatggggtttcatcatgttggtcaggctggtctcaaacacctgatctcaggtgatccgcccgcctcagcctcccaaagtgctgggattacaagcatgagccaccatgcccagccctatttctcccacatcttaagccaactttcccacaaacctgatgcctccacaaaccaccaactcatctttctccctgctttcactgttaaacttcttgacaaagtaggtgctgtatcagctatctttactttttcacctccaagtcactccttaatacattacaggataagttccccttctgtgaactttaccaaaattattctctcaaaggacactgacagtttccaaattgcccaagtcagtgatctcctctcagttatcatcttaaccaagcctttctctagttttaaatgacactgttgactacatacatcaactccatccctccagacccaccctgcacctcattgttcctccttctatgttctctattatggttactggtaccattcagtcacccagcctagaagtcttaaggtcaatctagtctttttctctctcacatcatagcctcttaacatctccaatattatttttattactattttgctcttataatctctcagttggactattcaaaaagtcttctaagatggaagttgatagcaataaacacctacatcaagaaacgtagaaagatttcaaataatcagtctaatgatgcacctaaaggaattagaaaagcaagaataagccaaatcccaaagttagcagaaggaaagaagtaataaaaatcagagcagaaataaatgaaatagagaccacaaaaataaaaaagatcaacgaaatgaaaagttggcttttcaaaaagataaaattggtaaaccactagctagactaaccaagaaaaaaagagaagtccaaataaataaaatcagaaattaagaaatggaacatcacaaccaataccttagaaatacaaaatatcatcagagactattattaacagctatacataaacaaactggaaaacccagaggaagtggataaattcctggacatatacagcctaccaagaataaatcaggaagatacagaaaacctgaacagaccaataataagtaatgaaactgaatctgtaataaaaagcctcccaacaaggaaaggcttggaccagatggcttcactgccaaattctaccaaacatataaagaagaactagtactaattctcctcaaactattccaaaaaaataaagaggagggagttctccctaactcattctatgaggctagaattaccctgatactaaagccagacaaggacatataccaaaaaaaaaaaaaaaaagaatatccctgaaggacatagacacaagaatcttcaacaaaatactagcaaactgaatatcatagcacatcaaaaagataacacatacaccatgatctagttgcatttatcccaggttgcaaggatgtttcaacatatgcatatgaataaacataatatatcacatcaacagaatgaaggacaaaaatgatatgatcattgatagatacagaaaaagcatttgataaaattcaacaatgcttcatgataaaaattctcaacaagctagcatagaaggtagatatctcagcataataaaggccatatatgataaacccacagctaacatcatactgatggggaaagcatttcctctaagaactagaacaagacaaagatttccactttcaacactctatgcaacatagtactggaagtcctagccagagcaatcgggcaagagaatgaaagaaaaggcgtccaaactggaaaagaagtaaaattgtccctctttgcagacaatttgatcttatatttagaaaaatcaaaagaaaccaccacaaaaaaaaactcttcaaactgataaattcagtaaagttgcaggacgcaaaatcagcacacaaaaatcaccagtatttttatacaccaaaaatgacatagctgaaaaagaaaccaagaaggcaatcttatttacagtagctacaaaccaaataactaaaaataaatttaaccaaggaggtgaaagacatctagaaggaaaactacaaaacactgataaaagaaactgaagagggcataaacaaagagaaagacatcccatgttcacagatcagaggaattttatggcaaagaattcaaaagcacagacaacaaaaacaaaaatagacaaatggaattacattaaactaaaaagcttctgcacagcaaaggaaacaatcaacagagtggagagacaacctattgaatgaaagaaagtatttgcaaactattcatccaacaagggactaatatccagcatataaggaactcaaatgattcaacaataaaaaatctaataatcccattaaaaataggcaaaggaaatgaatagacacttctcacaagaagacatacaaatggccaccagggatatggaaaatgtcaacatcactaatcatcagggaaatgtatattaaaaccacaatgagatatcatcttaccccagttagaatgactattattaaaaagacaacagatgctggtgagaatgcagagaaagggaacttttatatgctgttgataaaaatgtaaattagtacagctgctatggaaaacagtatggagatttttcaaaaaactaaaaatagaactaccatgagattcagcaatcacactgctggttatttatcatcaaaggaaggaaaatcagtatatcaaagggatacctgcaccttcgtgtttattacagcactattcacaacagcaaagacatggaatcaacttaagtgcccatcaacggatgaatggataaagaaaatgtggtatatatacacagtgaaatacttgttgtccataaacaatgagatcctgtcatttgcagtaacatggatggaactagaaatccttatgttaagtgaaataagctagacatacaaagacaaacataatatcacattttctcactcatatgtaggaggtaggaaatgcaaacttaatcaagtaatggctttcctctccttcccacttcttttccccatgcttaaaacccttcagtgggtattccataattatccattgcctagaggataaggacaaaatgtattattgggaataaaaggtgttttttggccacctctacagcatcaactcctgatcacctccccataccatgtcttttgcatccttgaaatttttccaccttgttcccttcaacatcactttttcctatttcccccctacctgtataatacctttcagtttctttctcaagttcttagatcctcgggtctttgttttttcttctcttttagttctagcaattcaattgccctgggcaatcttgtcccttctgatcaacctcattgtgtccaattaccaactattcatcaatagtttattaattttaatctacagcctccaacttctatcctaagccatagtcccatagacattctagtattgtcaataattacagctcatttattgaaaaactgctacatgccagcaattgcattagatgtgtgctagaacacatatctattaaataaacatgttctcatttaatcattacagaatgctgtaaagcaggcacaactgttccttctttgggatgaacacagacatggaatttatataatgttcccagtatcatataggtagaaagtactgaagcaggaatttaagctcagattggcaaaagaccatttcactaagatattcactactttttaccaaactccttcaaatgcacatattcttcagtacttattttattatttccaaacccaaatcactcctccatctgttattcccacattcactcatagcattactattaccaggaacaatacagaagtcttccaagtcacatttaactcctccatctaacttctccatatttgttgggtcactaagccacattctatgtctgaaaaagctcttgaatctccctctttttattgtagtatttcagtagctgtctcacagttctccagtttctgcccctgtaattatcttccatttctttgagagtttgctttctaaataaatctgactgacttctagataagatgactgaatatgcacaattctcttctctacttcctaatattccaattaaaatgatcagtgaaaccattaaaaactagagtaaccagtactacaaagaataacattctcacatcacagaattgaagaacttttgtaagtttaggccaacagaactttattgaaggaaggattggcccaaaccaagactcactagttaagaagtaacttgtctggaaagtaaataaagaaaaccaacagaatcccacaaatatgctcacatttggagatgtgaggctggaggtgaaagcagactgtgaagcaagtaggtgattccatattatattgtggcttagagttcaggtggacatttgataccaactcactgtgtcctttaagctgtaagggcatatactaatactaagtactctgtggaatattaagtcctctagtggaaggccatcttccactagacttaggcaaaggttaggaattacttccctcactccattcagggagggtattcacatacactatcatctttctccaaaatctctcccctaatctcccatctcctaactttcacaacctccatgtctttaagggatgcaaatgctgtctgactaattctaccctaactttataaattctaaaccactgtggccttcaaccccactttgaagtatggcatctagtatcttggggcttcaaaagaaacttccattttaatatccttttacattaatactctggataatgtttctatctgtgatttgatggggagggttttttttggggggggcggggccaaaaaaaaagtactcaaagctaaaaaaaaactccatccaagatcctttgtctttaaataccatttgaagttagactagtggattcaaatcctgactccagggactaactgtataagctttgggaacaatctaagcatcttaagtttcagttttataatcatatatgaataatgacaggccttcgtagaattttgtaaaaattaaataacatgttctaaacaaaactaaaaatatttctagcggcccataatgtcccagatgaaaactgccccttccacgtctctttgaccatgtcatctccatgtcatctctatgtcatctccgcctcactcatgccaatcactgttccacctcaagcgttctgctgccacttcttttttctccccctggaatattcattcctcagatagttgatggctaactgttccacctgcttcaggtctttgctcaaacacaaccttctccatccttctctgagcattccatgtaagcctaagccccttgttttacttctgcccttccctctatcccttccctgccttgatttgctccatagcacttatcatctttatcatactacatattttcacatttttactttaccttctgtctcctcccacttaatgtgggatccactaagaacattacctggcacataagaactagtcggtagccaggaacagtggctcacacctgcaatccagcacttttggagacagaggcaagagaatcacttgagcccaagtgttcaagaccagcctgggtaacacagtgagaccccatctctacgaaaaaagaaattaattagctggccatggtggcacacacttacaattccagctacttgggaagctgagggggaggatcacttgagcccaggaagttgaaactagagtgatccatgatcacacaactgtactccagcctggttaacagagggagaccgtgtctcaaaaacaaaaacaaaaacaaaaaacaaaaaacaaaaaaactagtcaataaatacaggctactgttgtaataataaatattataatgcagcacctctgtgaaatattccaggaatcagacctgactgcagcattgttcctggcttacacacagcatgtcaggcaaaagtgtatgtcagacaagaaaaaggatctgctcatatgaaagcatagggtaaaatcacaaggatcaatgagggtaagttaaatagtatcccataacatcaagttaaattaaaaattaggagaaatggggccagcaagatggccaaataggaacagctccagtctgcagctcccagtgagatcaatgcagaaggcgggtgatttctgcatttccaacccaggtacctggcttatctcactggaaatggttagacagagggtgcagcccatggagggcaagctgaagctgggtggggcatcccctcacccgggaagtgcaaggggttgggaaattccttcccctagccaagagaagccgtgagggactatgccatgaggaacagtgcactccggcccagatactacacttttcccactgtttttacaacccacagaccaggagattccctctagtgcctatgccaccagggccctgggtttcaagcacaaaagtaggtggcaatttgggcagacacctaactaggtcaggagatcgagaccaatctggcaaaatggtgaaatgccatttctactgaaaatacaaaaattagctgggtgtggtggcgcgtacatgtaatcccagctactcgggaggctgaggcaggagaatcacttgaaccaggcagtctgaggttgcagtgagccaagatcacaccacagcactccagcctggcaacagagctaggctccgtcaaacacacacacacacacacacacacacacacacacacacatcaggaaacaacagatgctggagaggatatggagaaataggaaagctttacactgttgatgggagttcgaccattgtggaagacagtgtggcaattcctcaaggatctagaactagaaataccatttgacccagcaatcccattactgggtatatacccaaaggattataaatcatgctactataaagacacattcacatgtatgtttactgcagcattattcacaatagcaaagacttggaaccaacccaaatgcccatcaatgataggctggataaagaaaatgtggcacatatataccatggaatactatgcggccataaaaaaggatgagttcatgtcctttgcagcgacatggatgaagctggaaaccatcattctcagcaaactaacacaggaacagaaaaccaaacaccgcatgttctcactcataagtggaagttgaacaatgagaacatatggacacagggaggggaacatcacacactggggcctgtcgaggtggggggcaaggggagggatagcattaggagaaatacctaatgtagatgagagattgatgggtgcagcaaactaccatgacacaggtatacccatgtaacaaacctgcacattctgcacgtttcccagaacttaaagtataatgaaaataaataaataaataaagctaaatttaaaaaaaagaataagatcatgtcctttgcagggatatggatggacctagaggccattatccttagcaaagtaacacaggaagagaaaaccaaataccatatgttctcacttataagtgggaactaagtgatgagaacacatggacacatacagcggaacaatacacactggagcctattggagggtggaaggtggtaggaaggagaggatcaggaaaaaaaaaactaatgggtactaagcttaatacctcggtgataaaataatatgtacaaacccccatgacataagtttagctatgtaacaaacctgcacatgtacccctgaacttaaaagaaaaaaaaaaacagtggaggcaattgcaaagacaataaatgatgtatttgattacattaaaaattgaaatatcaaaacattcccagaaaaattaaaaagaaagaaaaccaaagcagagtattcacacacaaaaaatataattttttaaaaaatctagattttataatttgacttaagaaacaacataacaaagactggtatggaagatgcaaaatttttaaatctaagtatgtcactgtttattaaagtagtaaaaataagagtaagtgaaatatacattaaaatgcacactagaatttggctgggtgcagtgaatcacgcctgtaatcccagcactttgggaggccaaggcaggcagatcatgaggtcaggagttcgagaccagcctgaccaacacggtgaaaccccgtctctactaaaaatacaaaaaaaaaattagccaggcgtggtggtgcacaactgtaatcccagctactcaggaggctgaggcaggagaatctcttgaacccgggaggcagaggttgcagtgagccaagatcgcaccactgccatccagcctgggtgacagagggagactctgtctcaaaaaaaaaaaaaaaaaaaatgcacactagaatttaagtttttattctctggttgcttttatttcaattactaatgttagaagctattttttagcaaatcctcacaactttgtacttttccaggcaatggccatcaatatcttcctttctctaaactggccaagaaatcttgataacaaattattttgacctcatgatattatatcagctacctctaagtgctttctctagtttatagcctagcaggcagaaactctgccttaattattcacatagtatctgatttaagtaacctattatatgcatatacttaattataataaattgtatcagggtctctcaacaaaatgaacttctattattgtaagcctacagatatagggaaagacttttgtctcaagcacgacaaaatctagaggttcacctaaaatagagattaaagaaaaagacctttcagttcctatggctattgtttcattaattttagcatacatgtaatttaccaataatctaatgtagtctattttttaaatgatttttaagtataactttgtctccattatgaatatatttttacaagttacttctaaaactaagtctatttctaaaaccacattttggaatggcaagtcatcttttctctcagaatgaaatctacaacataacgttaatcttttaaggatagagaggaagagaggattaataaagcaaatcttattccagtacaaataggaatctgtatgtggctggagaggtacctttatgctgaataattttcaagttatatgtaactttattctgcggttttctattcctgtgggactgtgagagcaggtgaaatatttgtcaccaaccataaaaaattatgaactaaagtaataacactacaataactaagctcgtctctaacagatgtattctgtggaaatttcccaagacaacagccttagaaaatggagtagtgttaatttcaactaaagttctccatattgaactatgtcttacaggtctaaagttctgatgcatctttaaataatgggttttgaaaaaagcttcatacatcttgataactttctcggctttaattgtgttgattctaacaatcctaatgagaaaaattaatgcctaaagccaatggtgataccagaaagatattaaaatacagctggcactctttatccatgggttccacgtctgcagacaagaagggtcaactaaggaacttgagcatccatggatttcagtatcctttgggttcctgcaaccaaccccctgcagatactgaaagatgactatatctggaacatacagattaaatgagatattgggaataacaaaagagggagaaatgaaggggaaaggtttcaagtgaattaattcttacttaaaaaattcatactaatagattaatttctcctttttgagagtcaatcacatgataagtcaatgtaatatttttcaatatacactaaatagtatagaatttggtgaggcacaaattccctgaactggatcaacagaagtttcttatttaaagtacaagaccatcattaaaagtttcacttacaactgtaaaccccaagaaagaacagatgctctgaagcattcttcacactgtccttaagtccctatgtccacctcttcctctgcattcagattaacttctgaaggaaatcctgaaatcaagcaaatataacactacagctacaggcattctttttttactctgcttagttcctctttcttcagtactaaaattaaagctatacaactgccttagcagcctgaataaatgttctatctttgaaggattagaaacctgcaaatggaaaaggcgttacaaacaaaacagtaacttaaaaagatacttcaggccaggtgcggtggctcatgcctgtaatcccagcactttgggaggctgaggcaggcagatcacctgaggtcagaagtttgagactagcctgactaacatggtgaaaccctgtctctattaaaaatacaaaaattagctgggcgtggtggcacatgcctgtaatcccagctactcaggaggctgaggcaggagaattgcttgaacccgggagatggaggttgcagtgagccaagattgcgccactgcactccagcctaggtgacagagtgagactctgtctcaaaaaaaaaaaaaaaaaaaaaaaaaatcagtagtatctttaggagcccaagaagccatcctaacgaaaaaaacacaaatgcttattaaggggatcctgatgaaaagactcaggatgttcaaagtcttaaatttgttttaaaaaccttcaaagtataaatagctattctaatatctaattcaataaacaaagagaataaggaaacataacataactgatcactgtaattgtgcataagtgcacatgcataaagaaccaatgattaaagacagaagtaacagtgatgttaagaaacattgatgttgcaacataacaaactaatgagaagcataagaacagtaaacattgggcaaatttgtctcaagctcatcttcatcagatttcagcttacagtatcctatctactcggaagtccttaatagtatataaaaatatctctaagcacttcaaaaaacaacattaagaagagcaaaatatggtggttttattcatgtggcttctcatttattgaaaattcagggtctccatgcttgcaatttgcaaacaactacaaacagcagcctcaattttctatcttatcacttgggaaaaagcactaaaatcatttttaatggtttattttgtaagcacaaattgtaagcatcagattgtgaaagtatcttgatgctataaacaaacagtaaaattacaatttacaatttaattaagaaaacaaaaaatataacctgtcattttattatttttaaaaatctaattgatttaaattaaatgccatgtttcatttgtcatataagaaaatataaattcacctttcatattaataattatacttcaattatattttatgatacaatatttaactactgatctaaaatatatattttcttatttttaaaatacattccataaataaaagacaatgattttctaaatatttaatggtgttcaaaaaaacagaaagaaccacattaataggagttcatgagccatatacggttggaaaaatatgctcttagataagcctgattattcccactctaccagtaataacaaaaagactcagttatgtaagtaatttgtgtccaagtttacataactggtgagcagcaacactagggtttaaaccagggccgtgtaactctcagcttattctatgaaatcatgatatcaatgaacaaatgaatgaattttatttccccaaggtttctgaataagaagctatttccacacactgttaggtggcttcattgtgccatcaataataacacagatacaattaaggaaataattcagtgtaacaaatattttctctagtccctatccaagtgtttagtactcaaaaatgaaatgctcatgtattagcaatctggctatcaaccaattcaaattaaaattccatttaccaatgtcatcaattacttcctaatgtcaactcttttgcagttttcattgcttgtggcctcagcagtcagtcattttccctcaaatattctcatttagttcctgttatgttacattaccctgaattttttctacctcttcattcccttgcttctatacaatcattgtaatgacataagtacaaatattaacaaaagtatatcagtgcaacaaaaaatatgacagagtaagtaacattaactaggacagagagaggtataaacttctagatcccaaaattctcactaagggatggatggctgtaaatgactgtattggaaagtcacatcagttcagacctcaggaggcagtattgtcccatctgggcatagtcttacatacagaagcaatccagcctgcatctgagacaggtgtatttttttctaacttcaagttgtataacatgtaacatgactgcaagagtactatacataacacattcaagcagttttttaaatccttaatcctcaccctcagactctctctagtctgataaagcctagtccctataaattactaaattcagtgtcatggaactggaactacaaatccctgggagtcatgctatataatctattctaatttctttcatataccccatattccctatattcttcacactcccaaaaatgggacccttcaaaggctcaggtctgaacccctttctcctccttcaatatatcaagcttatacctttgtgtttataattccacaatcaaatctcttgccctaaaagctttcccaagctcctttttcaaacctccccctgctaggcatcaccaccttggaattttgcagtcacctcaaggttaacatgtttgaaactaaacttatcctctttctaacacagccagtttcccttcttgttttctgagttgcagaagagagtgatccctggtttcctctcttctccctctctcctgcaacctatagccaccaagtcttgtaaattcagccttcataagtttccttcctgaccaccccaatcctcatctcagccctttttcccagagaaatgcaactgtttcctaactgatttctacacaaactgtctcttcctctccctctgctcaaactatatttcacacttcacttcctgttaaaaaatctttaatggatccccattgcctataaaatatctttcatactatttatccaattatttaaaattcttgttggatccctgtctctataacctcttctctctcttctcctatacatcagtcatccaatccagtcaaattgctccaaataaaacatgcagtcccacttacgtgatgttggttggaaatttctcacgcctagaatgctctcctttctctcctacacttaactaagccctacctttcaaaattggattgctatctcaaatctctcttattaaacacatgtgaaaaatgaaccattttctcataatccttgccaaaaaacaacatctaaactcctaaagaatccatccaaaagaaacacatgagtacacctaaaatctgaaagtcaggagaagaagaataatgtatgaatgcaaatttctttttccttctatattgaagcacttttggcctcatgtgttcactttctattcttaaaggtagagacttaattctattttctacagctcttaaaggctgataatgcagttattatgattgcgactagctagctcatcttgttagagaaagtatcatggtactgggttaagtttaaatatccatatggaatagaaaacttcatttatttgggtgccacaaattgcaaccctgacccttcccagaagtctattaatatctaccatgaacaccaagataatgtttgtggccagatgaaagtaaaaacagcctaaagtgaacacccaactgattttatttccttaaaatggatttgaaatagaatattttattattagttactttgaatattattgatatttacaaaaacatacttcaagtaaatctgcctaaaattggcttgagaactatctgaagagatttttttttttagattttcagaaaaatattcctcatggaatatctttccaattttgcagcataaaaaaatagaaaacattattttgtttcttatcaaactaatttttcaattttcattcatttaacaaataatactgagtatatacttatgccagaatttttctagacaccagtaatacagcaataaactaagtagataaagctgctgctctcaagtttacattctagtggaaggagatagaaaataaacaagcaaatatataatacgttgaatcgtggtaagttctctgaagaaagataaaacagggtaatggaaatagagaacactaagaaggaaaacagagaagactttattgacaaggtgatatctggacagatattttaaggattatagctattcataaaatatggaataccagcatagccaaaattcaggtaatactgtgatgtagtaacctaatgtttcctagttacattacttaaatattctgtcctactgaattaacaaatcctgggagtaaaatatttgtaaaagcctaggctgcaaccaccctcaatcatctgatatagacactatagttttctaagctccctccatcagcaaaatattcgttactcaaagctgatttgtactgaccctgtgggacacaagcccatttcaaggctgctggctatagcttgaaaagaaccactgagatgtaactgaacatttctgttcaagtagggctggccctacccctacctcctataagctttgacctggatacataatccggggctaattaatcaatacatccatctctttgacaactgagattggctcagcagtcaaaatgtgatcaaacttagaaatcttgcttgaatttggggaaagaagcgcttttggccaggattattaagcaaagaacacaatgaaccttgggctacttatatcccttgccaccatatgggaaaagctggcctgagaacaaaaccagtgtagaggaaaatccagctgaccaatggggaaaggcagattccagattacattgtttgagtactaggatccataaaagcctagatttttcatttatatgcgctaacacattccttttctgcataaatcagtttgaattggttttgaagagatacatggaaaatcagaaaataagatatggcagaaattttctcttcccattttcaacactgaactggtatattctaaatatggatatatgggtgttacctctttgatggaagtaaacaaggttttatcaccggacctaaagtctgaacacaaggccatttcaaaggaataaaatctaattttccttaagggagtcaatataaacaaaagaaggtccagggctatattggtgaccatcagaagctagtgcttcagaaagagtgtctcagggtttaaagattctggcatatgaaaaatattactttgagggaaaatccagtacacaaaataaaaggaattctaaagcaaatcaaatgaaagcaaatatagttcactgtcagaaaagataaagaaaaaaacgaaaaatagtacaaccagatatatagttgtataatccaagttttagctaggattcttaaaagtaattgctgacttgtccaccagacagtacaaataatcaataacattctatctcacagttgaattttgtaatcacaaaaagaacaagatctcaaattctctctcaagcatattagaattactgattttatttctttaaatatgtaaatttgtgagtgaggcacttataatttataactttttatgtgagtgaatgcatcaaaaattatgtgtaagtgttcaagataaccactctaaacagaagtaaaagacccgctatatatataataagcaaatgcttagaggtcactataatattcctaggaaaaaagtaaaacttgaaattgcattgcataaaggtctaattgttgctatataaacatatttcacaattttacctaggaagattttaattaataaattcatgtttatactactacctataactataggaaaagcttgtataaatgagaactacaaaaatcaacatgtatatggagaaaaattatttaaattataaaagatattgtatagccaattctacttagctttttaacaaacctgttttctctacttcttgggcacttagctaaaccatatttcctagtcttgcagtttgggacagccatgtgattgtatgactgagtactagtcagtggaagataagtggaaatgatgtctactgtttccaggcccatcccctttaacctcctacctcacctgtatcttccatcatctttacccataccaccttttgacagataagccaagtgaccttgaaaggttgtgctcaaaagggcagagtcaatagatgggagaaatctgaactccccctttgaggagagccacctgctgatccagaatacctgttttagactttaaattgttaagaaataaacttccattatatttgattcattatataatttttattttttaaaatagctagtattaccttaactaatatagcttatgattatatcactaatatgtgatcattgatattcatgattcattttatttttccactaattttaagtttttaatatccctagaactcagtacaaatgcattaacttcaaattataaaatattttaatattcataagtagtctacatcttcagtaaaactattttttgaaatttatttctttgcttaatcccagattctaaactttctttaacatttaattaacataattaaacttattcatggctttagtaatcaattagatctttctttaaaaagatttaattggccaaaagatttaattgtaattcttttttgaaatcaggataatgtaacctcttattaaaataaacaaaaaataaataaaaatcagtatgatacatcagttttgccatattcctataaagcatctcgaaagtaacaaaatgcttcaagaaaactaccataaaataacattaaaatatttaaaagaagaatggtcccgccagcatagctcttattcagtaagaatgaatgtgcagtccttctgaagaaacagatgaaaacaaaaaagaactaccccaggcaagactgaactaaaaatttttctcaatttccagtcaaactgtgttcacttttctaacatctacccatccacccacccattcattcttcttttgttcattgattcaaaaattgcatattggtattatgtggcaggccccataccaggattctgtgatatcacaaagatgaaatatatagataatgccctcaaggggttcacagtctaatatattcaagaacaagaaacaatcagaatttataactacttactacaattacaaccaccataagtactattacaggacattgggactctatattataaaaggcactgggagaaagcctaatacaaattggaatgaaggttcaaaaatgagctaagattagaagtaatgttttgatggaggaggaaaagtaaaaataatgaaattggtttggggcagaggagagtgtgagaactcaggtatagttatacatgctgaaagactggtgaaagagagtttggtaaatttatagaattataaataatggggaaaatgatgagagatgacaacacagccctaaataggagcaagttcatgacatgccttcattttccctattccataatcagatgattgttattatcacactttttcctgtgcctttcacctcatattcaaacaggacagaatcacttttcattttcactgattaaaatatagctatttctttttttaacacacttttataagagagctactatctgtcaggcaacatcccagactctcagatatactgttcttcctaactttctacaacaccttatactatcatttactggactgcttgcttggtaatacactttaccaccctgtatttcaattatttggtaatatatctgttttacctgccaaactccaagctccataaaacatggaaatgcctcagtcgttttttttgtctgccataaaacagtagctagtacgtaatataggtataacgaatgtttactgagtggatgaactaaagcaatgaagaaaaatggattagctttaaaataagagactatcattttagttttctcattacgcaataagattttttaaatatacaaaatatcataatgtgtattttatgtttatatttttatgttttgtaggatattgatactatttattggtaagtaataatattttattattgcagtaccccttcacaatatacccttatatatacaacttataattctgatagtttctgaaaacacattactattggaatgctgctaaaaatatgactagaattcattttttcatccatataaaaatgtttattgagtagttactatttgtaggacactatgtgaattgcttagcttttatatttcattgccattaaatacaataatgtaagaggtaaaatatgtcaaattaacttccctttgtacttagtcatagtcataccctgaggcaaaggaacaatgtcattcaacctcctttcataaataatatactttgaaacaatgactgattcattgttaaactgcatgattatatagtataaagattataaattcagttgaagttcaggtgttttttattatgagatactgtacttttaaattctggaatttccaattaatgtttttaatagatctcatttctcttctgagagtctccatctgttcaaagaaaaagaaaaagtctgagctggagtaagtaaggaggtttctatataaagaaagacttgaactacacctcataagatgaacaagatttaaacaaacagcaaagatgagagaatgaaacaatgagcaaacacaccatgcaagaaatgcctatgatatttttagacaaataacaaaggaataagctatactggtggcaggaaggagaacagaaagaaatatcattggataaggaggggtagtaacagaatcggaagatcttgacattcttgaactccaagaagaggaaggggccacgataatttagttaaaataaggctcaatattgtatcactgctctgtatacttcaatgtgtttttgtagtggctggtaacagtctttccttttcatatttagtgcttccttcagaagctcttgtaaggcaggtctggtggtaacaaactccctcagcatttgcttgtctgaaaaggatcttatttctcttttgcctatgaggacagagtcaaatctacacatatcaataccagccttaaatgtaaataagctaaataccacaattaaaagacacaaagtagggtgggcacggtggctcacacctgtaatactagcactttgggaggccaaggtgggtggatcacctgaggtcaggagttcgagatcaacctggccaacatagtgaaaccccatctcttctaaaaatacaaaaaatcagccgggcatggtgctgggcacctgtaatcccagcaactcaggaggttgaggcaggagaattgattgaacccaggaggcagaggttacagtgagccaagatcacaccattgcactccagcctgggcaacaagagcaaaactccatctcaaaaataaaataaaataaaataaaagacacaaagtggcaagctagataaagaaccaagatccattggtatgctgtttgcaagagactcatctcacatgtaatgacacacataggctcaaaataaagggacagagaaaaatctaccatgctaatggaaaacaaaccaaaaaaagcaagggttgctattcttatttcagacaaaacagactttaaactaacaaagatcaaaaaagacaaaagagggcattacataatcataaagggttcaattaagaagatctaactatcctaaatatatatgcacccaacacaggaggaagcagattcttaaatcaagttcttagagactttcaaaaagacttagacttccagagaataacagtgggaaactttaatactccactgacaatatgagaaagatcactgagacagtaaattaacaaaggtattcaggacctgaactcagcaatggatcacatgaacccagcagatatttacagaactctcccccagaatatacattcttctcattgccacatggcacatactctaaaattgatcacataatttaaagtaaaacacaccttggcaaatgcaaaagaactgaaaatcataacaaacagtctctcagaccacagtgcaattaaattggaaatcaagactaagaaattcactcaaagccatacaactacatgcaaactgaataacctgctcctgaatgacttttgtgtaaataatgaaattaaggcagcaatcaataagttatttggaattaatgagaacaaagatacaacataccagaatctctgggacacagctcaggcactgttaagaaggaaatttatagcactaaatgcccacgtcaaaaagttagaaagagctcaagttaacaacctaacatcacaactaaaagaactatacaaccaagagcaaacaaatcccaaagctagtagagtacaaaacataaccaaaatcagagctgaatttaaggagattgagacacgacaaaaaaaatccaaaagattaacaaatccaggagctgctttttaaaaaaaaaaattaataacatagaacaaatagctaagctaataaagaagaaaagagggaagattcaaataaacacaatcagaaataacaatggggatattaccccgaccccatagaaatgcaaacaaccatcaaagaatattatgaacacctctatgcacataaactagaaaatctagaagaaatgaataaattcctggacacatataccctcccaagactgaaccaggaagaaattgattctctgagcaaaccaaacctctgaaattgaagcaataataaacagcctaccaaccagaaaaagcccaggaccagaaagattcacgactaaattctaccagatgtacaaagaagaaccagtaccattcctactgaaactattccaaaaaattgaaaaggagggactcctccctaactcattctatgaggccaacatcatcctgataccaaaacctggcaaagataccacaaaaaaagaaaaattcacaccaatatccttcaggaaaatggatgcaaaaatcctcaaaaaaaaaaaaaaaaaaactgacaagctgaatctggcagcaaatgaaaaaccctatccaccataatcaagcaggctctatccctgagatccaaggctggttcaacatacacaagtcaataaatgtgattcatcacattaacagaactaaagacaaaaatcacataattatcacaatagatgcagaaaaggcttttgataaaattcaacatccattcatgttaaaaactctcaataaacagactttaaaccaacaaagatcaaagaagggcattacataatggtaaagggatcatacctcaaaataataaggacataccttataatgtccttattttgaggacatacctcaaaataataagagccatatatgacaaacccacagccaacatcatactgaacgagcaaaagctgggggtgttcccactgaaaactggaacaagacaaggaagccctctctcaccacttctattcaacatagtactgaaagtcctggccagggcaaccaggcaagagaaggaaataaagagcatttgaataggaagagaggaagtaaaaccatccctgtttgcagatgacatgatccatatctagaaaaccacatagtcttagcccaaaagcttcttaagctgataaacaacttcagcaaagtctcaagatacaaaaccaatgtgcaaaaataactagcattcctacaacaggcaagtggagagtcaaatcaggaacatactcccattcacaatagccacaaaaagaataaaattcctaggaatacagctaactagggaggtaaaagatttctacaagaactacaaaacactgcacaaagaaatcagagatgacacaaacaaaaataaattccatgctaatggataggaagaatcaatatcgtgaaaatggtcacactgcccaaatcaatttagattcaatactattcctattaaactaacattgagactcttcaagaactagaaaaaaactactttaaaatgaatatggaaccaaaaaagaaccaaaatatccaaggcaattctaagcaaaaagaacaaagctggaggcatcatgctacccaatttcaaactatactatggggctacagcaaccaaaacagcatagtactggtacagaaacagatacacagaccaatggaacagtatagagaattcagaaataagaccacacaccagaaataagaccacacacctacaactatgtgatctttgacaaacctgacaaaaaacaagcaatggggaaaggattccctattcaataaatggtgcttgaataactggctagcaatatgcagaaaactgaaactgtaccccttcctcataccatatacaaaaattaactcaagatggattaaagacttaaatgtaatacccaaaactataaaaaaaatcctggaagacaacctaagtaataccattcaggacacaggaatgggcaaagatttcatgacaaagatgccaaaagcaactacaacaaaagcaaaaattgacaaatgggatctaattaaactaaagacttctgcacagccaaagaaactatcaacagagtaaacagaaaacctacatattgggagaaaatttttggaaactatgcatccaacaaaggtctaatagccagcatctttaaggaacttaaacaaatttacaagaaaaaaacgaccacataaaaaagtgggcaaagaacattaacaggcacttcaaaagaagacatacatgcagccaacaagcatatgaaaaaaatgtgcaacatcactgatcattagagaaacacaaaccaaaaccacaatgagatgccatctcacccaaatggctattaaaatgtaaaaaacataacagacgctggcaaggttatggaaaaaaaagcaatgtttatacactgttggtgggagtgtaaattagttcaaccattatagaagacagtacggtgattcctcaaagatctaaagacagaaataccattcaacacagcaatcccattactgggtatatacccaatggaataaaaatcattctattataaagacgaatgcacacatatgttcattacagcactattcacaatagcaaagagatggaatcaacctaaatgcctatcagtgatggactgaataaagaatatgtggtgcatatatatatactggaatactatgccaccataaaaaagaatgagatcatgccctttccaggaacatggatgaatctgaggccattatctttagcaagctaatgcaggaacagaaaaccaaataccacatattctcacttgtaagtgggagctaagtgatgagaacacacagacaaatagagaacagcacacactggggtctactgaagggttgtgggtgggagaagggagagtattgggaaaaacaaccaatgggtactagactaatagctgagttatgaaataatctatacaacaaacccccatggcacaagtttatctatgtaacaaacctgcacatgtaaccctgaacttaaaatagacgtaaaaaaagtaaggctctcattgatttttgaccgtgaagtcatgaaatacaaactccatttcagaaagtctcatctggcagtataatataggtgtgggttagaattaagagagactgattgcaaagaaaggaacaaaaacattggtttgacaccttctgtgtgtccaacacactgctaaatactttttacacaaagtatacttcaataggaaacagtgagagactaagacaaaatgggaaggttagctataattatggggtaacctttcagtgatacagagaaaaatacatataaatgattcaacaaataaaatagaaatgacaggctaccattcgtttagtgtgtaatctgtggtgagcactgtgttaggtactccatacttatcacctctatcctcacaacaatcctgcaaggtactattattcttattgctaccatttttcatattaaaaaaatctaaacatcagggaaatatttaccagggaaataatacctgcaagatactattactattactattgttaccatttttcagatgagaaatctaaagatcagtgaaatatctacctatggagtagaactggaattcaaacacaagtcttttgaactcaaattcctgttctctaccctataatgtcacatacaatacaaaaatatgttattgaagaaattagtgtaattctttaatgcaaggactctttaatgtaagttagtgaggatgataattactatgacagtaaaaacactttaatgtttgagaaaggggcaccaggctaggtaaaactaggattagagattcaagggcaaaaggaaatctttcaaagctggaatggatttatttcagtaacaaagaatagattataggaaaagatataacatgtcaatttttgtctcatttattctgagggcaggcaattttcactttaatgatcccgcttctcactagttcattttctttgttcattttaaagtctttatttcctgtcggatttattcccttgactaagcattctttctccaaattaagactttgcttctcattattaatgatttgatagcacagactggcagctatcacctaaatggaactgttaggaaactgtaaacaaacacaacttttcagctttaaaaagcatagatggcagatgcaagaattctggcaaagccatgtgaaaataacatcagttttaaaaatctaagcctgagattgaagcaggccacactgtatcttttacttacgattattgattctgattctatcatagagaatcccaattcttcagctgttagaggctgaatgaattccaatattctttagttgtggcccaaatggtctcctgataaaatatgttgaagcatgagcaatttcagcaattttttctgggttactagtctactattccatcagaattaatttgctcttcaaggtgaaaagcatttcctcggacacagagttaagtgattattgcaactgccatgtctctttaagctcaggctctcgcctgatttcctttggcattaggcagcaaaatggatttttttaaatactggcaagctgtccaaggtcttcactcaaaaagagagccaagaactcccaaatgtaaaccttgaaatagaattacaaattaggtacactatgacaaatgaacaaggtaaatgtgaaaagtgactaaaagttaacttcatcattatccagaatgtgaggttaaaagaaaggtgaattattactacattttcaggaaaacattacaattagctcataagtgtaaagtacagattctcaggaaaattctaacagctgagttcttctactagaaagtttaattcaagttagagattataaagagattagaaagaacaaaagtatcaaaacaaaaactggccaataatatatctgaagagtatataaaaatggtaacctcacaaatgtcataaagttcaaaacataaaaattaaaatattttagaaaggaagtttactgcccttaatagaatgctcataatatagatgcatattttaacatcaaacacattttaagcacatgcacaatgaaatactgtgcatcagtgaagtccataaaaatgtgcaagaatcattaacaattagaaaaaaacaggatgtcatcaaccaccaaatatacattcttatcacctgcacagggaacatactcaaagattgatgacatgctcagccataaagcgagtctcaataaattcaaaaaaatcaaaaccataccaaccatatttttggaccacagtggaataaaaatagaaatcaatgccataaacatatctcaaaaccatccctcaaatcttttcaatttcatgaaaactaaacaacttgctactgaatgagttttgggtacgcaatgaaattaaggcagatatcaaaaaaatctttgaaataaactaaaacagacgtaacataccaaaatctctgagatgcagcagaagcaatgttaagaggaaagtctatagtgctaaatgcctacctcaaaaaatttttaaagatctcaaattaataatctaacatcacacccagaggaactagaaaaacaagaacaaatcagaagaaaagaaataaataaaataaaataaaatcagtgcagaagtgaatgaaattaagacccaaaaattcatacaaaaaaatctataaaaccaaaagttggcatgaaaggataaataagatcaataggctggcagctacattaacaaagaaagaagagacaatatccaaataagcacaatcagaaatggcaaaggtgacattaaaaccaatcccaccgaaatacaaaaaaaaccctcagagactatgatgaacaccatatatatacaaactagaaaatctagaggaagtagataaattcctggaaatacaccatatcccagggttaaatcaggaagacattgaaaccctgaatagaccaataatgaattccgaaatggaatcagtaataaaaagcctaacaaccaaaaaaaaaaaaaaaaaaccctggaccagaaggatttacagctgaattctaccagacatacaaagaagagctggtattaattctgctgaaactattccaaaaaattgaggagaatgaactcctccctaactcatgaagccgccatcatcctaatatcaaaacctggcaaagacacacacacacacacacaaaagaaaactacaggccaatatacctgatgaacagagaagcaaatatcctcagcaaacaaactaaaagcagtagtgcatcaaaaacttacgacgatgaaggaggctttctccctgggatacagggttgattaaacatatacaaaccaataaatgggatttaccacataagcagatttaaaagcaaaatcaatatgatcatctcaatagatgcaataaagataccttcaataaaatccaacatcccttcatgataaaaaccttcaacaaattaggcatcaaagaaacacaactcaaaataataaaagccatctatgacaaactcacagccaacattataataaatgggcaaaaactagaagcattttccttaaggactagaacaagacaagtatggctactctcaccactcatatataacatagtactgaaagtcctagctggagccatcatgcaagaggaataaataaaaggcatccaaatggaaaacaaaaattcaaactatctgtcttcactaatgatacgattctatgcctagaaaaccctaaactccaacaaaaagctgttgaaacttataaatgacttcagcacattttcagaacataaaatctatatatgaagatcattataatttctatacatcaataacattcaatctgagaaccacagtaagaatgcaatcccatttacaataaacacacaaaaaacgaaataccaaggaatacagctaaccagggaggtgaaagatctctacaatgagaactacaaaacccactgttcaaagaaatcagagatgatacaaagaaatggaaaaacatgccatgttcatgggctggaagaatcaatatcaataaaatgtccacactacccaaagcaatctacagattgaatgtattcttattaaagtaccaatatcatttttcacacaattagaaaaaaactattctaaaattcacatggaatcaaaaacaagctcgaatagccaaagtaatcctaaaagaatgaagccagaggcatcacatttcccaacttccaactatactatacagctacaataacaaatacttcatggtactggtacaaaaacagaaacatagaacaaaggaacagaatagagaactcagaaataaagccacacaactacaaccatctaatcttccacaaaaataaacaatggggaaaggacaagctattcaataaatagtgctgggatacctggctagccatacgcagaatgaaactggacccttacctttcatcatacacaacaattaagaaaagatagattaaagatttagatgtaagacctcaaactctaagaatcttagaatgaaacctagaaaacaccattctggacataggtctgggcaaagatttcatgataaagacttcaagagcaattgcaacaaaaacaaaaattgacttaaaaccttctgcacagaaaaagaaactataaacacagtaaacagacaacttacagaatggtagaaaatattcacaatccatgcatctgacaaaggtctaatatccagaatctataaggaacttaaaaagtcaacaagcaaaaaacaaccccattaaaaaatgggtaaaggacatgaaaagaagatatacatgcagttaataagtatgtgaaaaaaatcctcaacattactaatcattagagaagtgcaaatcaaaaccattgaatgcaatctcacacctgtcacaatgactattattaaaaagttaaaaaaaaaacagatgttggtgaggttgtgtagaaaagggatcgcttaaacactatttgtgggaatgtcagttaattcagctactatagaaatagtttggagacttctcaatgaacttaaaacagaactaccatttgacccagcaatcccattactgggtgtatgaccacaggaacacaaatcattctaccattaagacacatccacgtatgctcattgcagcacttttcacaacagcaaagacatggaatcaatctagatatccatcaacggtggactagataaagaaaacgtggcacatatacaccatgggatactatgcagccataaaaaagaataaaactgtgtcctttgcagcaacatggatgcaggtggaggccattatcctaagcaaattaacacaggaacagataaccaaataccacttgttcttactcgtaagtgtgagttaaacactgaatacacatggaaacacacatggacacaaagaggggaactacagacaatggggcttacttgcgggtgtagcacgggaggagagtaaggatcaaaaagctacatattgggtactatgctcattacctgggagaataaatcatttgtacaccaaatcccagtgacacacagtttacccatgtaacaaacctgcatatgtacctcactgaacctaaaataaaagctggaaaaaaaaaaacaaaatagccccatctcaataatacagaaagaataacaaggattaattcaaaaatgtttatcacataaatatttaggaattcaaaaattaataatgtaatcagacatatttcctatattcatatactatatacttccttcgtatatgttatcaggaattaaacatggtatttgtaatacaggatatccttctcatcagtgagagtgatgtactattacctaagaaaaatataatttgacttaagatcctagcgatatattgtgaagtcaataatatagtttacaggggtattttatttcatcctcaaagaaactggcgaggtattcattatttgaaaaatcacccaacaggggaagttcttctcagatcataaatattccatgttagaatttttctcatatgcctacaccgaaatacaggttatcaaacagatgtttttatgcccatgacctgttctatcaattcaataaatgtttgctaagcatgtgagtgaggaactatgctaaggacaaatacatgcacacacacagattaatattttccctgtcttcaaggagcttataggcaaagtcaaaaaagatgattcatgcataattaatacaaagcagcataatgatgcaaatagttagatctaaatagaaggatcaaaaatagttttcaataagtagagatggtagggataatatatatagacaaaacatgaacgtggacaataagaaagacagacgtgtttgagagtaatccattttatttatttatttagagacagagtttcactcttgtcatccaggctggagtgcagtggagctatcttggctcactgcaacctccacctcccgggttcaagtgattctcctgcctcagcctcctgagtagctgggatgacaggtgcacaccaccaggcccagctagtttttgtatttttagtaaagatggagtttcaccatgttggccaggctggtctctaactcccgacctcaggtgatcctccagtctcagcctcccaaagtgctgagattacaggcatgcaccaccgtgcctggccaagaataatccattttactaaaatatatttatctaagacattactagcagataaagctggaaaaatatgatgaagctagaaatgaagggtcttgaatgcctgagttaaacgtttctatttaacatttgcagtgaggaccagggctagttttgagtaggaaaatgacatgaccagaatggcacttaaggcatactgacttggcagcattgctcagaataaatatgagcagatgaagaggagagactagaagtgggtggacagggtaggaggctcttgaaataactcaggtgaggggaaatgatggtctgaacccacaaactggcaggaatgatgaaaaggtgagaggtcaatctggaagacagtaatgaaagacagaatgatctacttgtaagacattggacatacattcagatccaagatttaccttttgggcaactgactttactcctgattcccacgttgaggataataaaacctacctcatgggattgttgtcaggaataaaggagataatgatttttaacatgtttacacaatgcctagcatgtagtgaaaatttagtacttaataaatgctagcttctagtgttacaattattttgagatattatagtttggtcactgtttactgatttttttagtagctacatctcactgctggttcacgtagcagttgtagtcatctatataccctaaaacttttgtgtgaactactctctgacattaaatctcccccaccttgtatttataccattgatttttaaggaatctaaatataagattttatactaactcccactgaattctatgtttttaccttgagccaagatttcagcctattgagataatttttcatataagttcaattatttgtcatatttgctattcctccctaacttctacaaagctgattagaatacatatggctttttccaagtaaaatattgactcagaccaatccaagaacaaaatatttcactttcactagagaaatcccctctacgttgacattttgtgactatttagaacgtctggacaaaattggacaaagtctgtgaaacataaaaatcaagatctcttcagcaacataaaagagaacaaaatagctcttttctatggctgacagaaagccagagtaaaatttttttaaccgatgcagaaactaaggcttggaaatatcaagcaacttccaaaggtcaccctgctagtaaattgcagaacagagttgtacaaccaaatctgtaggactcacaatctcatgctcttaactgctagactaagttatctccctaagaaagatggttgagattcccatcatgattgctgggaaaaacctccactttggtctctggaattcatctccaaataattaaatgcattttgcaatgataatggttcatttgcaagaacatatacacttttatatgcagtctttgcctttttatgcatttattcagtcaatgaactttcactgagagaccactacattcaaggcaccgtgtgaggcaggatgtgactacagagatcaatctaataatgaacctactgtcaaaggggtatataagaagtaatgcaaaacatatacacctacaaggcaaggcagaaagagatgtatcaagaatggtaaaaagcaagtgtgctagaagttcagaaaaatgactcttttattctactagccattttctcaaggacttcctagattccctaaggttacaaaaagttcttcctgaggtgagggtaggaacaaaaacttacccttctgattctggatttttccattaatgtacctacagtacatacgtgtggttaatggtattgttttcaatatataaatgcaggtcaacatgatcctagttctacattccctaattcttgcaaaacctgttaggagatttccaaccttagttgaatcaccttgagtcaccacatccaaaaggtctgttcaactacataagaaatagattgttcaggttagaatgttcttttgaacattgtataccactgcttaagatttagcaccactataaaaaattatacatgctaaagaatcagttatgttcctataataagcctctatttacatttcaaaaaatttgcctcccaagattctctaaatctgatggaaattgggtaagatagccacgaagctctctccaaattctgaaattgatgcattcctgataataagctctagaaattgggttagaatgtgtttgaaggtaaactttgtttcagaaacaccatttggtttttaggcaatctaatctgactctactgatctttaaaacttgatgaattttagaactaaattaagtatattttccaaaagtagggacctcactcccagagagtattctcaagaatagcttggcattaaaaaaaactgaaaatccttcaaggtaaatcttgaaatcttaaaatactaaaataaaatacctcacacttcagaaggctgacatgtaattaaatattttgcattggaaaagaaagtaaaataacagaaaagaggcatagttgctgaacaaaattgcacaaaacctgccaatgcaacccctttcaaaccaaaagctttagatgctgcttgtgtcaagagaaaaaaatacataacacgtttcatcccttaagcttcttatttacttcttaaagacatacgctgatgaggtaatgttctattacaaatgtttaaaaaaaaaacaaaaaaacttttcctggtacctggattctgaaatctgctctaatgatctttatcatcaaatttctctatggcatgctgtgttcacatttaagaattgtatagattgtttatacacatggaggaaaaaacatgaatataaggcttgggaaaacataaagagaatagaaaattttttcagatgatttcacattctttcgaaaacctaaatttcatgagttggtaaagaatgttaggatatttatatttcttcaaaatttacattctagattatataatgtcctaattcaacttagaaaatggtttcagatgcatattataagagtatataaaacagactgacttttgaattaaaatgtatgcaagacaaaatgcaattttaacttgagctagcctttatattacatgcaaaacctccaattgaatacattcaatcataataagaatttaatttttaacttatattagtaaaagtgttcaaactaccatattatagctaatattttaatagaaacaaaaatctccgattcaaaaataaaagttcttacataagatggctggttttgtatttgaaattactgaatcagagtgccctctattggaagaaaagagacaacaaaagctaaactgaactaagaatataggtaaaatacttccaaaactcaagccacatcattaatatgtaaaacacattaattaaaaatatggatgctacaaaacatatttccttacatttttatttctccaaaataacttttggaattacttgtcatatcacaatcagcaagttggatgtttcatatcctatgaaattaaattttaactgaacccaaatgctcatcatttaaccagtaatataaataacagacatacagaaatgttttccacatttaatagtccaatataacatagaaatgttataattgaggactgtggtttgactgcagtttggattttccttgatgataaactgaaagcctccttgctatgaacctcatgtcggtgtccccgccaagtttatatgttgaaatcctaaaccccaatgtgatggtattaaggagggggtgttgggaggtcatcagatgataaccccttatgatgtgctagtgttcatataagaaaacatcaggagggctgggcgcagtggctcacacctgtaatcccagcactttgggaagccgaggcaggcagatcacaaggtcgggagatcgagaccatcgtggccaacatggtgaaaccccgtgtctactaaaatacaaaaaattagccaggtgtggtggcacgtgcctgtagtcccagctactcaggaggctgaggcaggggaatcgcttgaaccccggaggcggaggttgcagtgagccgagattgtaccactgcactccagcctgcgacagagcacgactccgtctcagaaaaaaaaaaaaaaaaaaaaaaacacatcaggagaacctgcttttttcccctctgttctttgccacatgaagatacaaccagaagacagccctctgcaaaccaggaagcaggccttcaccagctaccagctctgctggtaccttcatcttgggcttctcggactccagaactgtgagaaataaatgcttttttttttttccaagccacccaatctacgctaatttgttatagcacagataatccctaattcaagagacttttagaagctcttacactggggaattgcagaagtaggctggacattaagatttacgagatttgttccatctcaaaaaattctagttttgtggtgttttcaagacctcagttctgactcatcatctcagacctgaattacctcagaaagatcttggctgatttttggctccctagaccagtagtatggatgttagacctgagaagcttttccaagagcaatgctcagagctacccaaaattattttgatttagttggtctggactggtatctgagggcatcagtatttattttttagagcctctctaggtaaatctaatatacaactatggctgagaaccattgtttgagcctctccccagatcaagcaacatacaactaccacttttattttccaaaaatgtcactttcaggagaactctcctacacaagaatttattctcaggatcaattttaaacttctggctagcctcccaatctacttagctgcctttgttctctgacaatagagttgagtggcaaggggttatggctccagctccagaatgtctgtgttcttggctctgtaattaccgcatgaaactgggaaagtcataaaagctccctgtatggagaaataatactatccttttcaaagggttattgtgaggattaaatcagttaatacaagtaaagtgttccataaattgaggtattatcattacttacccaactttatttcctactactttccaaaacaaactctcatcataaatcattctcaaattatgcactaattctcatctctgtgcttttgcacttactgtttcttcaggctggaatcctttctcaatcatttgtcccaacaaaagtgaaaagcacagctcccctttcaccaggacacagcttagtctctccctacctccacaaagacttcaatgagtatctgtaaatattcactggtctctcccttttaaaaattcctttggccacaaggtagcatactatgagaaatgtggctgagaattaaaaacactggctcagagtttgaatcctcactctgccacttggcagctaagtcattttctaaatccatattgttaggattacttaataagcgacttaaatcacgtaaagcattagagtagcaaatagcaaaaactgagtaagtgtcagttcttatttattcagtgttttatatgttagccttcagttatagtctacacactgtgactgaagtctccttaggataggtgttttgaaacacttgaaatcaagaaccatatctattataaatcccacaactcaaaacatggtaagaaccatctgtattaggtgacctatattaggtgacctgtacttgactaaactttttgcaacatgtaagagtataattgaagcaatattctggaaaaaaaacttttttgatgaatagaaacaaatattcaacaaaacatggaatgaattcaaataaaacaggctacagaaaagggtcaaagtaatttgattactttttaaacattcgctaacaggtttctatcagattcatcttctgaaaggtcagttccaatgatgtcttttatctgcccaaaatcctttagatttttctcatttcttaaaaaaaaaaccaaaattcttagcctgacattcataattatccatgacctgacctcaaactacacttctactctctcatctttcccctttgtaaactctattcttccaaataaacagaattatttgctcttactcatatataccatctgcttttctccctccacataatctttaatattttatagggaaatattttcaaagaacactattgtaaaggtttgtcacaggaacgaagagtggtgttagaaaagcatgagttcagatttcaaaaccttaacgctcaatttatgagcattaatttctttcttgccactatcacaatacagtctttggcttacaaaaaaaattgaacatcttttccccaaactattatcactctctcaaagtcaaaagcctttgccgtaacttcctgaaagatagaagcttgaatcatggtctccaagcagcacatacagaccccagggcatataagatattcattgggtaaacgaaaaataattagagcttctgttttacacttattctctaccttcctcaatttgaatttcttttgttgtgtatgtctcataatttacatcaaatattactagaaatgcagtctatatatatataatttacaaataatcagggatatttgctcaaaatttgtttactaatggtacgtacaacaaaaaagtttggaaaccctggtctaaaaaattagggctttcagaatatctgtggttttacaagtagaaggccagaagctgccagtttacataaatctttgaggatggatctaaaaatataaacactatgtgttgtttatatagcacaaatatgttttaagttctaactaactttcaaggaaatattaaaatgtaactgattggtaacctggagacagcatacacctatttcagattttttaacagaggattttgtcccaacattaaagttactattataaattatttcattaatataaaaatttcatttggtaaaacttacaggtatttacttcagtacatatacaactgttcatagttattcataaagaatttttattggggccaataataggatgtttttacaaaagagagtgaagcacaaaaacaaaatgaaacaaaaaaagcaggccaaggaggtaggactagccatggaactagattagcaagtgctatcccaggaaacagtgtcacagcttactttaagtaactaaattaagtaaatgttctcataatggacagtcactatacttagcaagtttttttttagttttcacaaataatatgacatacttaacacagttcactctattactggcttttgaataaagtatgatatatctgtaacaaattaagttctaaaagtgactacagatttcttatcagaataatgtatttcctttaataccagtatatactataagtccttcctctacaggacaaaaagtaggtttaaatatcttaatattaaactgatttattctctatagtttttcttgcttttgtgttcatataaaaatccaaatgagtgagaatcacccatggcctgacctcaatctatccttctaatcttatctcccctctttcttctttgtaaactctcattcctaataaatagaaatacttgctcttactcaactatatcatctgtttttctgcctcacataacctttaatattttatatggcaatattttcaaagaacactatcataaaggcgttgtcacaggaactaactcatgcttaagattctgagcttatcaaagagaaacctcttgggatttgcataatattataaaaatatgcagactgaactttccacatttctctcctactatgacttcaggaggaagtgaggaaactatacgtgtggctctgctctgttagtctgagttcatagagaaaatggggaagacagtcgaaaggaaggtttttgtctttttttgggaaccaacatcattatgcccagtaaaactaaaggaacacaacaacaacaacaacaacaaataccaaaaatccatgtttttaagaaagagtctaaaagtagagagaccatgaagtgatctgtcaaagcactccttcccctacacatgcactgcgagtaaaaccccaaagaacgtcaggaaaagagcaataaggaaactgacatcttagagtggcggaatctgataatgcaccacatcccatacctcttaagtgtacacactgaactggcaaagacagacacattatcttcattcccccccgccttacttactacactctggcttccatttttcccaagttcttcctctgaaatcttgctcaaattatctaagtagtggtctgatattgtgtggcacaagtcttcaaacgaataatccttttcttgacagagttttatttcatccaagagttttgataattctccagtgacggtttcacctatgagaataattttttcagaagtttcaagaaaggctattgttaaaacttaatgttaagcaataaaaatatgactgctatggtgatagaactcaaaatataacaagattaagcagtcagacactattctgctgaaaacaaggtactcaaccataattagtacaacaatattaatgggcaaaagagattataattttgcctatttttattctttttcaaaatagaaataattattgtaaggttatgtatacatagtacataaaagcatctggaattacaattcccaaagcttcacttattataggatttaatttccataatatttcattggtattttacttcactgacagaattcattagcaaatttgaaacggtgctgagaaacttcttcctaggttcaataaacagaaatagtacaagttatttaaacaaataataacataggtaatcagtaccttaagaattatggtatatgatataaagtaaaaacacaaaagaaacaaacaatatgcatcatctgtcaaacatgaagattttgtagattacatgaaaatatgcacatttctaaacagtctcagaaagataccttatacctgtaatttattctgaaaaaaatgcccagcagttacaatccagattttaatatttttattctgacataaaaacatatttaacatcagctgactatagatgcatggatttatttctggactttattctgttttattggtatatatgtctgttttcatgcctgtaccatactgttttgattactgtagctcttcacaaggtttccaagaacacaaaatgtggaaaagatagtctcttcaataaatagtgttgggaaagtggatagccacatgcaaaagcatgaaatatgacccttatctcatcccctatgtaaaaatcaatgcaaacagtataaagactggaacattaagacctgaaaatatgaaactcctaaaagaaaacatagggaaaaaacttgatatttgtttggacaatgatttcttggatatgaacaaaagcaaaaatgaacacgcaggattggatcaaactaagaagcttctgcactgcaaataaaacaatcaacacactaaaaagataacttaaggaatgggagaaaatatttgcaaaccatagatctggtaaggggttaatgtgcaaaatacataaggaattcacataactcaatagcaaaaacacaaataacctaattttaaaatgggctaaggactcgaatagacatttcttcaaaaaaggcacataaatgacccaaggtatatgaaaaggtgctcaatatcactaataatcaggcaaatgtaaatgaaagccacaatggggtatcatctcccatctattagaatggctattctcaaaaagacaaaagataggaggtgtttctgaggatgtggagaaagggaaccctgtatgctgtccatgggaatgtaaaatgttaaaggctctatggaaaacagtatggagattcctcaaaaaattaaaaatagaattaccatatgattcagtaatcccaccttggggtgcttattcacaggaaatgaaaccagtatcttggagagatatctgcacccttctgttcattgcaacattcttcagaacagccaagacatgaaaacaactgaagtatacactgtcagatggatggataaataaaatgcaatgtgtgtatacatttatatacacactacacaaacaatggactattattcagccttaaaaaaggagatcctgccatttgtaacaacatggatgaacctagaggatattatcctaagtgagatgaaccaggtacagaaagacaaatactgcatgatctcacatgtggaatctaaaaaagtcaaagtcataaaacagagagtagaatggtgaatgccaggggctggggagtggaggagatgggaaagtgttgatcaaagggtacaaaggttcagttatgggggattaataaattctggagatttaaaatacagcatggtgactatagttaataatattctattgtatacctgaaacttgctaagagagttgatcttaagtgttctctccaaaataaaaaataaaaaatactatgtgagatgatggctatgttaattagcttgattttggcaattattccacaaagtatatatcaagttgcacactgtaaatatatacaatttttatttgccaagtatacctcaataaagctggggaaaaacacatttaagaaaaaaacacatttaagaaacatatactccagataaacttcattacagcagggatagttttctgctttgctcactactgtatctcagggctgagaagccctaatcagtaacaggagctcttataaatggatgaaatatagagtataggatataacctattagacttgaaattttcacaactgtacatacaagtctagtatagattccagggctttataattaggtactcacttttggtcttttgggaaggagactcaacaggagatgaaatgtgtgtttcttgtgttgcatcttcctgtacaggctcttcgaggactgtagatcttcccacgccttctaaatactctgtgtgtatacatttttgagattacatacttgaattcatttattttaaaatcaataaattttaagttttacttctggtaatcagtttttcatttattttttcatatcctaaatatatcctaagttttcaaaagaacttcaaaaaaccaaacatatcaaaagaacgccatgatgagctatttaattaaagttgtaattaaaaaaagacactggattatttgggagaaactcttgaacccctttcttctaaaacctaaacttaaaacattctttccttaaaaataaattcacctattgaagatacaataaactccttggtctccttattttccatctgaagattttaaactgtctgaaagatgctttgaatagatttaatccccaaaacaggaatgtcaaattcagatggataccacaaccagccaggtaacataaacgaatgaaatggaataagttcatttcaaaatggtgctgtaatcttgtaacataagcataatttgcatattaactttatttccacaaagaaataatgttcattgccattattcttgaagtaatgtcctatactcagcctatttttcatttttctagttttgatacagatataatattaggaatagcagcttaaacttaaatattgcttactatggacccagcattgttctaagtgttttgtataaattaactcatgtaatccttacaaaactatgacacatgcactaaattttaaagattacaagtaaaggaggagtattattaacttgtccatgttcattcagctaataggtggcaaagccaaataaatataagacaagaaaacatctcacttttctcttaaccataaagaaaacagcatctgaatgtagaaataaatgttaaccaatattcagcctcacagaccatgttgaaccagagaacaaatgaccaatctaaagttcatccctgaaataaaacttcttttagagaaaccaaaactccagagtttgagctaaaatcctagggttttttttgtttctttttggttgtttgtttgtttgagatggattctcgctctgtcgcccaggctggagtgcagtggtgcaatcttgactcactgcaacctccgcctcccaggttcaaataattctcctgcctcagccccccaagctagctgagactacagatatgtgccaccacacccggctcatttttttttgtatttttagtagagacagggtttcaccatgttcgccaggctggtctggaactcctgaccttgtaatccgcccacctcggcctcccaaagtgctgggattacaagcgtgagccaccgcaccctgccaaattctagatttttaaatgttaacagctaattcaatttttatggaaacacaatgtgggctcaaaatatgtgatatatacaaagcatgtgtgctatctgccaaagcgttcagcccacaagtggctagtttgtagcctctgtataaagattaaatgaacagatcccttttcatacagagcatttgcttatacttctttattcaagaacctttttcttaaaatctaataaagaaaatttgtattctcatgccaaacaagtatgtcctcataccattcaaataatttctaccagggaaatccaggaatgcaaagaacagagatgacgtgttcacattctgaaatttgccagtaattagagaacttcaaagatgtactgtatgccctaccacaaattaacatacctaattaatcttgaccatttaggagagcaaagatagttactcccatgtaacaacatttcatcttatataaaccaatgcagtatgtttttaaaaagtccatggttatgtcacaccccattttctagtgggtgacatttattttgcttttcccaaaagacatattacacacatgcttcagttttgtttttttgtttgtttgtttgttttgtttggtttgtttgagacggagtctcgctctgttgctcaggctggagtgcagtggcgcgatctcggctcactgcaacctctgccttctgggttcacgccattctcctgcctcagcctcccaagtagctgggactacaggcgcccaccaccgcgcccggctaagtttttgtatttttagtagagacggggtttcaccgtgttagccgggatggtctagatctcctgacctcgtgatccacccacctcagcctcccaaagtgctgggattacaggcatgagccatcgcgcctggcccatgcttcagtttttaaaagttcagtgagaggcagccgggcacggtagctcacgcctgtaatcccagcattttgggaggccaaggcgggtggcccacaaagtcaggagatcaagaccatcctggctaacatcgtgaaactccgtctctactaaaaataccaaagaaattagctgggcatggtggcgggtgcctgtagtcccagctactcgggaggctgaggcaggagaatggtgtgaaccggggaggcagagcttgcagtgagcccagagggcgccactgcactccagcctgggtgacagagtgagactccctctcaaaaagaaaaaaaaagttcagtgagaggctgggcgctgtggctcatgcgtgtaatcccagcactttaagaggccaaggtggctggatcacctgcgttcaggagttggagaccagactggccaacatggtaaaaccccctctctactaaaaatacaaaaagtagccagacatggcggcaagtgcctataatcccagctacttgggagactgaggcaggagaatcacttgaacccgggaggcggaggctgcagtgagccaagattgcaccactgcactccagcctaggcaataagagcaaaactctttctcaaaaaaaaaaaaaaaaaaaaattcagtgagagtcaaaagtccaacatgaaatacaaagtgcatagagggagaagactaataaaaaatagtatgtgccactcttattttttagcttttattcaatttaattttaattttaatttatataaaaggctatgatgggatttttctctgattcatctctgcatgcatttgacttgtaattaacttctttattgataagaaaattgtaggggcatgaacttccctgaaatattttggaaatagagaagagagcataatggccacatatagtgcatctattccttttactcctccttggcctttgttgactattgtatctacatgttccctgcctgacttggttttaattcatttatctccctgcaaaacaatgctgttcttcagcttcccaactgacacctaataaaacctatctcaccaccctcctctatcatacttgcagccaatccataacaagtgtaggagataatcactgctgaacagggtaggagctaaaggagagaaaaacatctggggtttttaagtaacatgctacatgtcaggcctaatcaccaaacaggaagagaaagcatttaagtctaattttgttataaaacttttagttcaagtggagaagtatgcaagctgcaaataacaaaagtcgtacctagacagttgtcaaactttcaatagagctaatgactgccactaacaacaaatgcacttaaatgacttttaccaaaaactaaggctggtaagactgagttattttataccattggattaggaaggaaataatctgtattcttttggctaaatacaatttttgttattattgataatctagcatttagatacaagctctgccacttaagatacatgaatttgaacaaatcaaatctctcagagcctcagtttcccttatgtgcaaaagtaaaataatatctgacttatgttacttcatagggtcatagaaaccaaagtagtagcaaatccctgaaaatgctgaaagtattattcaaatgtgaaataacacttaatcatcactactttatagccttattaacttccagctcataactacatatttactacataaatatgaattttaaaaatatttctattatcaaatgagtaaataaataccttaacttctttaaaatacttactgagtagttgaaaaacaaaaataaaacattaaaaggtattattatttagtttaaaagtctaccagaaaaaaataaaactagtaagtttgttcaaaagtaaacactaactcaaaatccaaaagaaaactgtaacagttttaatctcatcttaactttaaggcaaactcatccatcattcaatactgtttaccttgtaagagtgttgcaatctggagagatttctgagatggatgttctttcagaatgtccaagacagttctacctaagctatcctttatgttggcatcaattcctgaaagaaaaagaaaaactcactagatatacaccactgaagtatcctcaaaagatactatcactatctaactgctgtaatttcagacatatacagaccaagcattgaaagtgatttttaaaaaattaagttctacacacacacatacacacacacatgcgcacacacacacacactcacacaagattttagcaagaaagaaggcaggggcctgttgctaccaaagattaggaacattcttgatcatcaattaactcttaaagggcactgacccaatgtttaagattgtttttcaggaccctatgatatctttttttttttgagacggagtctcactctgttgcccaggctggagtgcagtggcgcgatctcggctcactgcaagctccgcttcccaggttcacgccattctcctgcctcagactcctgagtagctgggactacaggtgcccaccaccatgcccaactaatttttttttttttgtatttttagtagagacggggtttcactgtgttagcaaggatggtctcgatatcctgacctcgtgatctgcccaccttggcctcccaaagtgctgggattacaggcttgagccaccacgcccggctgaccctatggtatctttgggttataactatttaactcaacagcacactatcacactgaaaaatattattgatttagaatgtgaattcctaaagtataatggtcatgtgatttatattctctgtacaatatggtaaaaatatttagtaaattataatcatgtaccatgtaagtaacataagaacagtcttagaacacttgaatattcacaaagttgaaaaagcatgattattttgaattgttgtccacaaagaatttatccaaatacaaggtcaaatactctatgatatttatttatgcaagattgtatttgtcagtcacactaatcatccacctgacgagcaaacttactgaagtgtgtaactaaaacacctgttattattttagttgtggaaatatatattgtaagaaagaacttattttaacacagcaaatagctttcactgccctaaaaatattatgaattttccaaacacataattgcaaaaaaaaaaaaaaaagccagtttacaggatctggtcccaaatgttagttcattgtaagattattaaatacatgtttaaatttgcataggaatgtgtaaccagcacatattaatatttaggtggtttcctcaaatcatttgttatatcaccacactgcatgacaaagttaaatataaatgaaattttaactttgttaaattgtgtacaaatacaatcacaatacaacagtctgccaatgtttttcatttttttttacagaggaaaataaacacactatagtccataacatgaaaaattccatcagttgtttacaagcatgaatttgtacccatgccttttgatctttaaaacaaatctgaccttaattctagctctatttcatctcaatcagaatgcacatatgaaaataaataagccaactttattgttccttcaaagcactccctttaaaaggttccctttaaaataagtttctgtagcctactaacaatagctactcagttaatgaactaactagaaggacaatttaccttaaagagagggaactcaaatctctgtttaccgtagtccacaatataaaacacagaaaaactattatgttcttcaataaatcaagcaattgtgaaaatttctcaaggatcaattcctctctcttacagaaggcagaaatttcctttttcttttggtagttcatctctaaagtacttaagtgcataaaattgtaataacaaagaggtttgtacttaaaacatctattgcataaaagaagttgcacattgatatcaatgttatctaaatactgaaactcagttctacataatatgaatacatatctgcattttagagtaaaggcaagagggtgatttgtgaagaaaactgtgtcattttcctttgtctattcccaaaatagaaatgttatctgtcaggataagctccatgcagaatcacaatagttacctgtttctaacagaactcgtacaacatccacctttccaaacaaagctgcttcatgaagtgcactccccttttctgtctggaaaaaaaaaagtaagaaaaaagaaagcacggttgcatttggaatgcttacaggttgaaataaaatgctcacattttacatattcatacatatttgctgtaatctcagctctccctaacagaaaggtcatgtggaataaagaagagattctaaaagcaaaatccatcggcttggggattgtaaaatacctctgcttctaaatagaaatttgggccagatgcagctgaggcggatggatcacctgaggtcaggagttcgagaccagcctggccaacatggcaaaaccccgtctctactaaaatacaaaaattagccacaggtggtggtatgtgcctgtaatcccagctactcaggaagctgaggcaggagaatcgcttgaactcaggaagcagaggttgcagtgagccaagatcatgccactgcactccaacctgggtgacagagtgggactccatctcaaaaataaataaataaatagccatttgactttcttatgtgagtatttcaccttctcttagctttagctctccttaagtataaaataagagaagtaatgcccacctcacaaggcttttgtgactatgcaagaagctcatttaatcagcatgcatttattaaacaccaattataggccaagagtagctgatggatattctgaggtatggaaatatcatcctggccctcatatattcacattctatttgaagagacagatgtataaacacagatgctccttgacttccaatagggttacctcctgataaagccaccataaactgagtatcccttaaattgaaaatgcatttaggctgggcgcagtggctcatgcctgtaatcccagcactttgggagccaaggcaggtggattgcctaaggccaggagttcaggaccagtctgaccaacatggtgaaaccccatctctactaaaaatacaaaaaaattagccaggcgtggtggcatgcacctgtaatcccagctactcaggaggctgagacaggggaattgcttgaaccagaaaggtggaggttgcagtgagccgagatcgcaccactgcactccagcctgggtgacagagtgagaatccatcgcaaaaaaaaaaaaaaagaaaagaaaaagaaaagaaaatgcatttaaacacaggtaacctaccaccaaacatcatagcctagactagcctactttaaatatgctcagaacacttacattaacctagtgttgggcaaaatcatgtaacacaaagcctattttatgataaagcattgactatctcatatactgcatatcgctagcctgagaaaagatcaagattcaaaatttgaagcatatcaaaaatgcgacagtttcacaccattttaaagtcgagaaattgttaaattaaatcattgtaagttgggggctgtctgtaaatatttatgataaatgaaatctaaacaatttaatgtagccataaaaaagaataaaatcctgtcattcacagcaacatggatgagcctggagaatattatgttaagtgaaataagtcaggcacagaaagataaataccacatgttctcacatatgtgtgagctaaaaaagttggacccatagaagtagagagtaacattatggttatgagaggctgggcaggggagcagggagaggaggatagggagaggttggtgattgactgcgaaattacagctatataggaggaagaagttctagtattctttagtagggtgatgatagttaacaataattgattatatattttcaaatactggaagagaggattttttaatgttcccaacacaaataaatggcaaatgtttaaggtgatagatatgctaattaccctatcattatatactatatttcatgtatcaaaatatcactctgtacccctaaatatgtacaattatgacatgcaattaaaaataaaaataaatttaaaagccaaaaaaaatttaatgtggcttaagaaacccagatgatattttctccctgctttcctctccgtcccatcctttgcccatcacaaccctcttccaaacctcataccctatgctccaggcatactgaactttctttttttttttttttttttttgagacggagtctcgctctgtggcgcaggctggagtgcagtggcacgatctcagctcactgcaagctccgcctccagggttcacaccattcccctgtctcagcctcccgagaagctgggactacaggctcctgccaccacacccagctaatttttttgtatttttagtagagatggggtttcatcatgttagccaggatggtctcgatctcctgacctcatgatccacccgtcttggcctcccaaagtgctgggattacaggcgtgagccaccgcgcctggcccctgaacactttcataatcatttcatattgctttcttccacagggggtctccaaggctggtctctctgcctggcaggatctaactcctagcactcttaatctagccatctagatatacctaccactagttaattttcagcatgaataagaaccatgtggagaaactgtcttaaaaacatacttctgggccccatccccagagtttctgattcagtcgcctgagattaggccatagaatttccatttctaacaaattcccctgtgattctgtaggtctaaagagtatgctttaagaaccataaacatgtacgatatctcgaatcttagcttaaaataattgcatttataaagacatccctgacccctgaagtttagtgtttttcctggatgttccacatcaatctatattttccttatcacagcactcatataccacattataattttatgtaattgtctggttcccataataaactgtaagttcagcggaaatgtaggccacatctattttttcaccattgtatccccaatgcctagcaaagtactttgaaaatatagatgtttaggaatttttctgagggcaagaagtggagggagggaagaacacaggatgaaaaactaggacaatttgtgagtagtgcaggataagactgattctgccttcaggaagctcaaggaagattccaaagatgaagctttttgagctacacgaatgttagttgtctcttttttttttttttcattctttttcttcttctctcaagaatctaacaagtatcagtaggtcgtgtgtgtgtgtgtgtgtgtgtgtctgtgtgtctgtgtgtgttttcaattgaatagtgtcaaggtagcaattttgttgccctatactaaatgtgatctctaaagtgggattctaatctcaacctgaaatagaaatatcactataaaataacatacaatgtaaaaactcttttttttttctgtttttcttttttgagatggagtcttgctctctcgcccaggctggagtgctgtggcatgatctcagctcactgcaacctccgtctcccaggtgcaagcgattctcctgcctcagcttcccaagtagctgagattaaggcatgcgccaccacgcccagctaatttttgtatgtttagtagagaggggctttcaccatgttgaccaggctggtcttgaactcctgacctcaaatgatccgcccacgtcagcctcccaaagtgctgggatcacaggcatgagccactgcgcctggccaaaactctttaataaaagtctattatataattaacccaatctaaagtagataagtacattattaagcaggcttgaggaacactgaatatcaatgtgatctgactgtatcttcaagatggaatgactgaaatgcccttgaattataatctgactggcatgatatgtagatactgaaaaaaatggaaacaaaaaaataatttgtaaatatacagcacagttttgaaggaaatgagaaactggaaactgattcggctcttaagaaaatatttcaatgtggggcatgaacattttattttttcccttccttaaaaatattccttgaaataatctaattttgctcattctcatgctgtttttcaaccagatttctgattactaatttgattcccttacacttttcacaaaattttggacttgatttcagataaatccttcctgatatagcatacttcagttcattctgaaaacaaaccaaagaatattttaattcaggattgcgaggggaaagaaatagaattccccacagccttagggaaaggcgaggacagaaagtatgaaccccagggggttagctttggaacaggtatttgttccagggagtctgtcaaccaatgctagactagtgcctggactttaaccagccactcaaggtacgagtggcagtggggcagaagacagtctgaagtctaagcaagctgaaagtttaaatgagggacccctacaaaactctaaaacttctaaagaacatcctcagtgaaaattaaaacaacaacaacaacacattgcacagaaggggaaaggatgtctaactaggtcttagttgtagatagagtgaaaaaagtaaatccccctaagaatgcctaaccacaattctacactcacatggtaagtttaaggcaaaattgtacaatctctatgaactccagatcctcatccaaaatgtagaataaagtggtcctgggtttctagtaatacaggcagatataaatgcttagaaaaaagcagatataaatcccctctgtaaaagtacactttcaactcaggcctccaaatattccagcagatgaagctctaagaaatacaaattcaaaattataaattactgaatgtgaaaggaagcatcccaccatgaacaaggattagtaaataaaaatacaaaagaataaaactcacaaaaatttcacatattgaaatggtcaggtatagaatataatacatatgtgataaataagatgaaagaactagaacaaaagaataattatcaaaattgaccagatgtgaaaatgaatcaaatagcattctagaaatagaaaatataatatttaaaatcaatggcttaataacatataaatagctattgaaggggtattaaactggatgatagatttttttaagtacataattgatagggtttggctatgtccccatccaaatctcatcttgaattttagttcccataatcttcatgtgtcatgggagagaccggctgggaggtaatttactcatgggggcaattaccctcatgctgttctcatgatagtgagttctcacaagatctaatggttttataaggagcttttcctcctttggctcggcacttcctcttgcctgccaccatgtaagatgtgactttgctcctccttcaccttccaccatgattgtgaagcctccccagccatgtgaaactataagtcaattaaacctctttcctttataaattacaacctcaggtatgtctttattaggagacatactaataggagacttaattaggagaacagactaatacaataatgcaataaaaagaataagagatgaaggacagagcaaaattgcagaatataagcctacatcatttgtcttccccactggaacaccgaatattaacaactatctgcacacagaagagcattgtcacaagaaccaaaaatcaagtgaacaatcacagtatctggttttaacttcctactgctgaaatagacactgaggagggtggaagagaaagtcttgaatcacgggcgctgcccctctcccattccatggcagtggccatgctgtgcagatagaaaatctgtgcattttaggaagggagaaagcagtgactgaggaactttacattgaactcagtgctgctttgccagagtggacaataaagctgtgtggggttccgccagtgcccacacattgaggggacatttgcaccagcccagccagaagggaatcacccatggaatgtgagtctctcaacaagcctcaccactgcactgcaggctgaagtgctctgggatcctcagtaaacttgaaaggcagtctaggacacaaggactgcaattcctaggcaaatcctagtgctaggctaggcttagagccagtagacaagattggcgcatgacctagggagacagcggcagatatggctaacgaagtgcctatgccattcctccaccaacctcaggcagtgcaagtgcaattcacaacaacaaaagtaacttttcccttctatttaaggagaggagagtgaagagtaaagaggactttgtcttgcatcttagatgtcagctcagccatagtaggacagggcactgggcagagttgtgaagccctaaatcctggacatttctagatgtaccttgggccaaaagggaacccactgccttgaaggaaagaacccagtcctggcaggattcatcacctgctgactaaagagctcttggagcctaaataagcagcagcaataactgggagtacaccatgggccttgttgtctgagaaatgctggcttcaagggtcatccagcacagtcccagctgtggtggctacggtgaacaacttcttctgtttgaaaacagcagagggaaaagtaaaggggcctttgccttgcacctaaggtaccacttcggccacagtaggaaaaaacaagcaggcacacggggtctctgcgttcaggcctaggctcttggacaacatttctgaatctgtcctggaccagaggggagcctactgccctatagggtgagtctgaggcctggcaggactcaccataagctgacaaaagagcccttgggctttaagtaaacattggcagtgacctagaagaaccctcgtggaccagaagtggtggtggccacagggagagtctcctctgcctgtggaaaagggaagaaagagtaagaaggactttgtaatgaagtgtgagtgccaatttagctgcagtaaattagaacatcaggtaaactgctaaggtttttgactctaatccttggcttccagacagctactctggacatgcccagggtctgggggaactcactgccctgaagattaggatacagtgctgagctggcttcaggtctgacccaacacaatcccagtggtggtttccgaaggggtgtttgcatcaccacacccccaggtacaggtggctcagcacagaaagacagactctgtttctttgagagaaaggagaaagaagagtctctgcctagtaatacatagaattcttccacatcttatccaagaccaccaaggcaatacctctatgagtctgcaaaaaccacagtgttagtgggtttggggcccaagtcccttcaaatgcctggaaagtcttcctaagaaggacagatacaaacaggtccagactgtgaagactacagtcaatatctaactcttcaatgcccaaacatcaagaccatccaagaaaacatgacctcaccgaatgaattacataaggcaccagggacaagtcctggaaaaaaaatagatatatgatctttcagacagagaattcaaaatagctgttttgaggaaactcaaagaaattcaagataacacagagaaggaattcagaattctatcagataaatttaacaaagagattgaaataattaaaaagaatcaagcaaaagttctagagttgaaaattgcaattgatgtaatgaagaatgcattagagtctcttaagagcagaattagtcaagaagaaaaaattaacgagcttgaagacaggtattcgaagacacactgagagtctacagccataccgccccaaacgcacccaatctcatctgaaaacacactgagaagacaaaataaaaaaagaataaaaagcaatgaaacctgctttcaagatctagacaacagtctcaagagggcaaatctaaaagttactggccttaaagaggaggttgagaaatagttaggggtagaaggtttattcaaagtgataatattggagaacttcccaaacccagagaaagatattaacattcaaagacaggaaggttatagagcaccaagcagatgtaacccaaagaaggctacttcaaggcatttaagaatcaaactcccaaaggtcaaagataaataaataatcctaaaagcagtaagagaaaataaacaaataacatacaatggagctccaatatatctggcagcagacttttcaatggaaatcttacaggtcaggagagagtggcatgacatatttaaagtgctgaaggaagaaaacttttaccctaaaatggtatatctggcaaaaatatccttcaagcatgaaagagaaataaagaccttcccatacgagcaaaatctgagggatttcatcaacaccaggcctgtcttgcaagaaatgctaaagggagttcttcaatctgaaagaaaaggaaattaataagcaataagaaatcatttgaaggtgcaaaactcactggtaatagcccacagaaaatccagaataaccctgtaattacggtgtgaaaactacttttatcttaagtagaaacactaaacaatgaaccaaaaaataatgactacaatgaattttcaagacacagagaatgaaataagacataaagagaaacaacaaaaagttaaaaagttaggtggcaaagttaaactgtatagtttttattagttttctttttgtgtgtttgtttgtttatgcaatcagtgtcatcatcagtttaaagtaatgggttataaggtagtatttgcaagcctcatggtagcttcaaataaaaaaacatacaatgggtacgcaaaaaaattaaaaagcatgaaattaaagcctactgccagagaaaatcaccttcactaaaaggaagacaggaagaaaggaaaaaaggaagagcagaccgccaaaaaaagagagcgagagaaaaaaataacaaaatgacaggagtaagtccttacttatcaacaataacattaaatgtatatggagtaaactctccaatcaaaagacatagagtggctgaatagataaaaaacaaaacccaatgatctgatgcctacaggaagcacatgttacctataacgatacacacagattaaaaataagtggatgaaaaaagtattccatgtcaacagaaaccaaaaaaccacaagagtagctatacttatattaggcaaaataggttttaagataaaaattgtaggaaaagacaaagaaggtcattatataatgacaaaggggtcaattcagcaagaggatattacaattgtaaatatatatgcaccaaacactggagtacccagatatataaagcaaatattattagtgctaaagggaaagatagacctaaatacaataatagctggagacttcaactccccactttcagcattggatagatcttccagacagaaaatcaacagataaacattggtcttaatctgcactttagaaaaaatggaacattttatctgatggctgcaaaatacatattcttctcctcagcacatggatcattctcaaggacagaccacatgttaggtcacaaaacaaatttttaaacattttttaaaaatgaaaaaatatcaagcatcatccctgaccacaatggaataaaactagaaatcaataacaagagaaattttggaaactatgcaaacagacaaaaattaaacaatatgctcctgaataagtgggtcaatgaagaaatcagaaagaaaatttaaaaattccttgaaataagttcatggaaacacagcataccaaaacctatgggacacagcaaaagcagtactaagaagaaactttatagccatcaatgcctacatcaaaaaggaagaaaaacttaaaataaataatctaatgatgcatcttaaagaatttaaaaagcaagagcaagctgaatgcaaaattaagagaagaaaagaaataataaggatcagagcagacataaatgaatttgaaatgattaaaaaaagacaacagatcaacaaaacaagaagttgttttgaaaagaaaaacacaattgacaaacctttagccagactaacacaagagagaagacccaaataaatgaaatcagaaatgaaaaaggagacattacaactaatatcacagaaattcaaaggatcatgagtggctgatatgaacaactacataccaataaatggaaaaatctagaagaaatggataaattcctacatacatacaatctactaaaattgaaccattaacaattccaaagcccaaacagacgaataacaagtaacaagatcgaagccataataaaaagtctcccagtaaagaaaagtgcaggaccgatgactttgctgatgaattctaccaaacatttaaaaaactaataccaatcctattcaaactgttctgaaaaataggggaagatggaatacttacaaacccattctacaaggccagtattaatctgatactataccccaagacacaccaaaaaaagaaaactataggccaatatctctgattactattgatgtaaaaatcctcaacaaaactccaacaaaccaaattcaacaacaaattaggatttatccctgtgatgcaaggatggttcaacatatgcaaatcaatcaatgtgataccctgtatcaacagaatgaaggacaaaaaacattatcattttgactaatgctgaaaacatatttgatgcagtccaacatcccttcctgttttaaaaaaaaatagtcaaaacacctcaatgtaataaaatccatatatgacagactcacgactagtatcatactgaatgggggaaaactgaaagcctttcctctaagacctggaatacaacaagaacacccactttcaccactgttactcaaaatagaactggaagtcctagctagagcaattaaacaagagaaagacataaagggcatccaaattggaaaggaagaagtcaaattatccttgtttgcagataatacaatcttatatttggaaaaacctaaagactccactgaaaaactattagaactgataaacaaatgtagcaacgttgcaggatacaaaatcaacatacaaaaatcagcagcatttctatatgccaacagtaaacaatgtgaaaaagaaaattttaaaaatcccatttacagtagccacacataaaactaaatacctaggaattaaccaaataaatgaaaaatctctacaatgaaaactgtaaaatactgatgaaagaaattgaagatgacatcaaaaatggaaagatattccatgctcatgaattggaagaatcaatattgttaaaatgtccatactaaccaaagcaatctacagattcaatgcaatacctatcaacataccaatgacatttttcacagaaatggaaaaccaatcccaaaatttatacagaatcaccaaatacccagaatagccaaagcaaacctgagcaaaaagaataaaactgaaggaataacattacctgacttcaaattatactacaaatcagaatggtactggcataaaatcagacacatagaccaatggaacaaaatagaaaacctagaaacaaatctacacacctacagtgaactcattttcgacaaaagagccaagaacatacactggtgaaaagacagtcttcaataaatggtgctggtaaaactaaatatccatatgcagaacaatgaaactagactcctatctctcacaatatacaaaaatcaaatcaaaatggattaaacatttgaatctaaggcttcaaactctgaaactgctaccaaaaaactttgagaaaaatctccaggatattggtctcggcaaagatttcttgagtaataccccacaagtacaaacaaccaaagcaaaaatggacaaatgggatcatatcaagttaaaaagcttctgcacagcaaaagaaacaatcaacaaagtgaagagacaacccacggaataggagaaaatatttgcaaactactcatctgacaagagattaataaccagaatatataaggaacaaaaaaactttacaggaaaacatctaataatacaattaaaatattggcaaaacatttgaatagacatttctcaaaagaagacacataaatggcaaacaggtatatgaaaaggtgttcagcatcattgatcatcggagaaatgcaaatcaaaactgcaaagaaatgtcacctcaccccagttaaaatggcttttatccaaatgttaagcaataacaaatgctggtgaggatgtgaaaacaagggaatcctatatactgtaggtgggaatgtgaattagtacaaccactatgaagaacagtttggaggttcctcaagaaactaaaaatagagctaccaaatgatccagcaatcccactgctggatatctaccccaaagaaaggaaatcagtattttgaagagatatttacaatctcatgtttgttgtggcactgttcacaatagccaagatttggaagcaacctaagtgtccatcaacagatgaaaggataaagaaaatgtggtacacacacacacacacacacacacacacacattttcttggagtactatacagccacaaaaaagaataagattctgtcatttgcaacaacatggatggaactggagatcattatattaagtgaaataagccaggctcagaaagacagacatcacatgttctcagttatttgtgagatctaaaaatcaaaacaattgaactcacagagataaagaagggtggttaccagaggctgggaagggtagtgggggcacaggggttagagggaggtggggatggttaaagcgtacaaaaaatagaaagaatgaataagacctagtatttgatagcacaacaggggcactataatcaataataattcaattgtacatttaaaaataaataattgtaacacaaaagataaatgcttgaggggatggatactcaattttccatgatgtgattattgtacattgcatacatgtaccaaaatatctcatgaacccataaatatatatacctactatgtatccacaaaaattttacatttaaaattttttaaatgactacagaaacaaataagcaaagaaggtaaaaaagaaataagagatggaaaatatgaaagatagaataaaataagaggattcaacatatgtctaatcaattttagaggaagaagatagaggtaaataatagtcagtggctaagaactttacataattgataagacactaagttccaggaccagcaagcaagataaatgaaaagaatacatcctggacatatcacagtaaaactacaaaactactaagataataactttaagacactctgagggaaaaaattgcctaaaaagaaataataattagatcaatagcggacttcacaacaaaaataaataataaagtcagaagaaagtataataccttcatgtgacaagagaaaaaaaatctatcaacctagcattctacattcagtcaaactaccttctaaaaatgagagtaaaataaaaacattttcagacagactaaaaatgagtggttacttacaactcttactgaaagaacttctataggatataattcagaaaaggaactgagatgcaagaagtaatgataaataaagagaatggttaatatgaggctaaatctaaacaaatatttaaaaatatgatagtgtctacttttggcactgatttggcttcacagatactttgataaaggatgatgcacactgtagacacggaaaaggtcccactttatacacagggaatatattccaagcaccccagtggatgtctaaaaccaaagatagtactgaacccgaatgccatcaatcagaattcatttctgttcatgtcttccatccacaaattcaaggccttttccatcttaactaagcacttaccgtgcactatagctgtaacttctgtagtttgaggtgcaacagcaaaactagtacaaatttctttttctttcttctcaacttcagatagaggattcattcttaccatagatcttagcaacctctgtgtacaagtttttcttttctttagtaagtcaagaactttcaccttttcacttagaggaagcactttacagcttctctttggaatatgcaaattgtcagcatcactgctcttgtgctttggggccattattaagtaaaatatgggtgacttgaacccaagcagtgcaataccagaacagtcgatctgataatcaagagggctaccaataggcaagtagtgtctacagcacagagatgctggacaaagggatgattcatgtcccaggcaggacaaagtatgatggtgagagttttcatcatgctactcagaatggcatggaatttaaaacttataagttgtttatttctataattttccttttaatgttttcagaccatggttgactgcaggtatctgaaacagcagaaaactaaacatcagataaaggttgggtgggcggcaggggtagggggaactattatattctagacaatgaaaatacataatctccaccataaataaacaaatctctttctggaaaaagcagatggagcaaacctgggttccagtggcagcttggcttttagtatctctgaaaattcatatatcctatgagaaacatattaaaaacctaacagatacatccatgttgtgtgggaaaaattaaaaataaaatacaaattttaaaaacctaatatggttattgggaaggttaaataagataaacatacaacaaataagattttttaagtgttttattaaactataaagtaatgacaagtattatcaataatatttctattaaaaaagcaattagaaaacctattttaaaagtaacctcaattatgttaatattaattacatacatgtatatcctttacattattccaagataaaaatgctatgttaagtagaactaatgttttcatacaataagaagacacagaattcttcaataaaaacagaaaaggttagtagatgataaacatatttttagcctgtaaaaatgaatctgtttttacaaattcaaggttgctgtaattagcttctttggtaagagaacatgagaactgtcaaatggaatggattggtctcataattctaaggtaaacaatggtaccaagaactatttactgctatcacaatgttgtcacatagtgtacagaatgtaaatatgtcaaacccatggacttttcaaaatatagattaattttgtaataatttccttcttttcatcagagattagaaaaatttaagaatattttgccaaggtgtaaagtaagatttaaaaaaaaatcaagtgccttgtggcttatcacaccctagacagagtccgtgtctaattgtctaatattctcactcaaatgagcactattctgtacatctcagcattctgccccaaatctacaacccataaccggccagaccttgaaaaattctattcttgtgaaatatttagtccaaaacattttacaagaaagtaggaagtctacaaagaaacaacactgaacaaggtgaacccaaaggctcccatccctggagatttcagtcctgcttttcttatggatcaaaattctccattttatttaaattaatcatttaaaaaaaacaaaatttccaaaatcgataatcatgcagtttataacacagtgacatttcaaaacttatccagtaaccacacataaagcactcataacatctcagcaccttttaggggaaaaaaaaaagacaaacctctgaacacagtgatgaaaacagctgagcgaaaagtactgaaatgatatatatgttaacatcaataactgaattgttgatgaaagcaaaagaaattctctcattgattggaaatgcctgttaaagtcaagccttggtagcaccaaagctgagaaaaacaagataagtcgcaagcaaaagggagagaagatgacgttcatgtttacagccctgggtttcagcttcccttctttttggcgttatatatttctgtgacttccatggaagctcagttgtgcatttaaagggatgtttgttatattttatccaaaatttctagatgttttaaagtcgtttttaggttatctattctaccagagtgccaaaacagcagatggaaaagggatgcaaagatgtcagagcttagctgcactggtttccccttccaaatttagcactccaaccataattatcctgaagcctgcgaaagagaataatgagataaagaccgattcttgattaaaggagaaaataaagataacaattatgataagcaataatgattgtggtgacgatcagcagagaaaatagcacagatagcataaaactgtgagaagcaagacccacaactattgtaacaactggtaaataaagataaccttactggagatgaagaaaaaacaactagaatggcatttaactcagaaataaaattccctagtaccctgtttggtacttagccacgtgggcacctcttggaattaaaaaaaaaaaaaaaaaaaacaaaagataacaactcaacttagtgtttgacaacaaacatatgatgtctgaacaagttggaaggcagcagctcttttgcattatctagaccatatctagaggagtatgttcaattgtgggtatctaacttttaggaccaatgacagaatacaatgtgtccagagaagagagtgccaaagaataaaggacctagaaaaacatcgtgtgaagaataaaggttataagaatgtttaaactgggaggaaaatggcacaagagaaatatgacatgtcttcaaataattcagaataccattgttgctattcaaaagaagaaatctccctctattaaactagggacttcaagtcttggtctttactcattctctcttccttcacttcatatcaaaggaagcacccttcttttcattaacattatttctccacttgtgctctttattctatcactttctgctgcttcttgaattttgatcatctctgcctcttgcatcttcaaggcaatctttctccataaacatacacacctttccactatttaaaaacaaaacaaacaaccaaagaaacttcctgtgaacctgctttcacttcaagcttctatccgctatcttacttttctttattccacgctttatgaaaagtcatcttccctcttttaggcacaatttttgcctagttttgttactgctatatcctctggcacatagtaggcactcaataaatatatgataaatgaattgattacatgaaattgtgctgtcttggcattcctcttttaactgcttctttacagacctttttccagaaactccctgaatattctttaatcagcctcttctgtctccctacattctgtttcttgtaagcccttctatctcatggcttcatctcttactcctctgaggctagcctcttagaaagttagcctcatttaaggagcacatccaaagagagacctctctgacccttccgtctcaatcacagcacccagtttgtttccattatagcactcactgcaatttatcatttttatgttgtttatgtgcttattttctgtcatccctactagtctataactccatgggagcaggaaacaaattttcttcctcctggagcatagtgcctggtagcatggcatgagaagtcaggaggggctagggtatcctcatagggaagccagggttcagttaaaagtgaaagaaagggagttgcttgggtagtgagtaaggtaagtaaaggaaggcctcactattaaggtgacattggagaagacacctgaggaaagaagggggaagaaagtcatgagggttagtaaggcagaggcctggaggtaggagtgtacataatgtgttccaacaagaacaacaaggtcactgtggatgaagctaagtgaagaagggcaaagaagagtaggtggtagctttagagagacagtgaaactaagtaatataaaaccctatcagacactataaggactctggcttttcctctgagtgaaatggaaaaccaatagaagtgtttttgagtaggaaaatgaaattacctgactgaatgggatcacttctggctgtttgactgaaaatagactgaagggaatatgttatggattgaatatctgtgtgccccaaaactcacatgctaaggccctaacctccagtgtgactgtatttggatatatggcctttctggaagtagttaaggttaaattgggtcataagggtgtggccctaatccaatggaactggtgtccttataagggaaagaggaaacatcagggaactctctctccattcacgcacagaagaaaggccgtgtgaggatataacaagaaggcagccatctaacaagccaggaagaaagccctcactcaggaatggaattggccggaacttgatcttggactttgtagcctccagaattgtgagaaaataaatttctgttgcttaagccactcagcctataatattttgctgtggcaacctaagcagacaatacagaagccaaaaaaaaaaaaaaaaaaaacggaggaaaactagtcaggaagcaagagatgattaggtcttggactatggtgttaatcttgaagataatgtaaagtagtgaaattctggatacaatttgagcacagaaccaataggatttgctgaagaactgaatgtaaaatctgaaagaaaccgtaaaattctgggccaaacaactagaaggatggcactgccttttgacaaaatgggaaagacttggtgatatgcaaatttttgaagaaaggggtacagatgctagattttcagctttggaaatgctgagtttgagaagcctattagtcatctgatagatatgtccagtagggaattacatacacaaatttagagttagggtggagtctgagatgaagaaatagacttggtaattgtcagataaagatgatattggaactcaagagattggatgaggtcaatgaggaagtaggtatagacagagatgaaaagatgtttgagtactaagccctgggacactccgatgcttagagatcaagaagatgagggcagttaactatggaatagggacacgatagattacattattggcctctccttttatatgctctttgccgtatgactttgtacttctttccacttatatgagttgagtatatttctcttcctctttatttgaggcttggttttgtgacctgatttagccaatggatggtaaccaacatgatgcaagcagaggcccaaactgtgcttgcatgattgagctttctctcttatgcacaatcaatgcccccctgcctagtcccaggaggaagataatagacacgtgcagcagagattcccaggctaacttacagcatcaaacatacttcccccagcttcttcaagaagtcaccagtgaactaaatgaaaaccaaaagacagtcgtatctcagaggtcaaaagaaaacggtggttcaaagaagagacagatactgactttgtcagtgctgatgatgaatcaagtaagaggagaagcaggaattgactgttggatctaaaagtatgtcagtcattagacaacttgacaaaggcaaaaacaaggacttttaaaagtgagggagttagagtggcctcaagagagaatggaggaaagaaattggatacaatgagtaaaaacaagcttttctaactacgttgctacaaaggggtcagagaaaggggatggtaaggagaaggaaatgtgagatcaagagagtttttaaaagatgagaaatattacatctttgcatccttatggaaatggtacagttgagaaagaaaaaacgtatggtattaaagacagaaaatatttgtcagagttcccacgtggacaagaaaggataggatccaatgaacaagtagagaggaattagccttagatacaaacctaaaaggttcatttaaagcaccaggaaggaaagtagacacaggtacattggcagatgtggtggtggaaatttgtgattgcttgtggtttcctcagtgaaataaaagcagtatcatgatcagagagggatgatagagaaggaggtgttgaagttttggaatagagatgtcgtgaaattatcatctagggaaatcagagagtaaatggattataatggataattatcgcctatgtacatatcttatttctggtgccactataagcctttgagagcaaaagctgtatcttacttagttttgcatcttaacagctcttagcatggaaacttgtactttttattattaactttctgtaattttactttcatttcctttaatagtcacataaagtctaattggcttaaggttgtactagttctttaactcttcaagtcttatgagagaaacttataagaaactcacacaatgaaagcactagcatgatatggcactatcgctatctggttacccaaaatcaagttcaaaattcataaaaataattgctaacttcaagagaaaactgcccattcaaccctactttcttaatatcttactttgactgattctctttattaaaaaaatatttaaagactaaagggtttataagtaaagatgatatgaaatttgcccaaagtattacttactattttaaatatgtgttataatttaaaattactcagagagtaatgatgcagaaaataaacttctagagcaaatattaacatcaatgctgcatttaaaaacatatgtaggtcaggtgcagtggttcaaatttgtaatcccagcactttggaaggccaagaaaggaggatcacttgagcccaggagttcgagaccaacctgggcaacatagtgagaccttttctctacaaaaactaaaaaaattagccgagcacatcagcacatgcctatagtcccacctactcaggaggctgaagcaggaggatcacttgagcttgggagttctaggccgaagtgagcatgattgcaccactgccctccagcctgggtggcagaataagaccctgcctttaaaaaaaaaaaaaaagtaaaataaaataaaatcacatgtaactactaggaaaagacaagatcctcaaaagccatctataagttttaaagatttattcataataacttgaatgtaattgaagtctaaaagtacaatactataatttaccaaatgggattacttttaatactaattcccaacaggttagctagagcagtttaatgaatattaaatctactgaaacaatttgaggctactagctacattgttcactctcagccagtgagaatatcaacaaacctacttgatattcaaaaattttgcactgagtctgatgggaaaaacttggtaacaattaatttgagtaataaaattaaatattcacccccccccaaaaaaaaaggcaatgagaccaaaaaaaaaaccaacatattttctatgaacaaagcaacaataacaaaagcaaaatatcaactaaggctaaatatattatggaagattcatttcattgagatatattttagaaagatgttgtcagttctacttcctagaattcttagaatgagtgtcaatagaagaggttatagcaacacagaagttgtccaccttactcagacatcaccccgatacttctgattaggtgttcaaagtgatctaagcatattgtctgcctttcttctgatatgtgaagaacaaatctaaatgtggtgaggaccaagcagacaatctaaaggaatgacaatggcaatgatataaaatggtagaatgaggtcggagccttggaaagcatttaccccatctaaaagcactcaaattcaatattttaaaatactctttagccaaataatgcacatatgcaagctaaaggccacctaaaattcaaagtcgtgttggactttcaaaggtccccttcaaatgtcacttccatcaatgacttctcatgttctccctcttaaaatccatattttcctcacccgtagatccacagctctttgttttagcatttattatatgtcatggatgggagttattcttgcaaattttttgtctcctccactaagcgtggggcagagatagttttggttttttattctccaaaagcacaaaatacagtgttttgcagaaaaaaaggacacatcatatacatttataaaattgaatttaaactctttcccttctggtcatgtcatctagtacaaaacatgaaaggatcttggtcagggataccaagaagcttactgacctcagtcagaggggaagtccttggttatattgcagtctgtgcaatcaagtttaaaaatattacagaagtgtgaaagcagtacatccagattagagaaattcaacatttatacaataaacatctagtttatcattaaacaacttttaggaaaataactttgtgagtcacctacaatagtaagcatacctacttattttcaatacccctttgaggagagagactgtttttccttaatatgactgttagaaaaaattcttatgcttttttgagaggctgccaaagttgaataaataagaaattgagaaaagatattacaaatatctaaactactaaataatgcaggcaaagctctaaagcaagctctggttcagggtgctagccttaaaactgagattggaaggcctgagatttttctaaattcaataaagaaaactctggaaatacaggattcaatctctgaacaattcctaggaaatataaccccatctgtgagcacgcattccacctggagtgtgtaattatttgcaacatttgccacatttagtccctctgggtattcacacccttttacaattcacgccctcttctaatacagaggtagactctattttccaactccttgaatatgggttgcctttatgacttgcttcagccaagcaaacatggcagaagtgaaggtgtactagttccaagcctaggcctcaagaagccttgtacaattctgttctctctctcagaaccatgcatgccatgtgagtaagcccaggctgacctgctgaatcatgacagagaagtggcagtctcacctatcaccctagacaacatccagccagcctctgaaacagaaacacataactgatttgcagttgatttcacacacaagagaacacagccaagaccagaagaaccatcagttgagcttagactaaattgccaatcacagaattatgagctaaataaagagttattgtgttaagctattaagttttgggatagtttgttgcacatcaatggcttactaataaggggagaaggtcacaatatgacagaaagcaaaaaagtctctggaagataagaatgctgccattaacttggaagccaagaaataaccatgaaaggaggaaaaggcaaaaaaaaaaaaaaaaaaaaaaaaagactaaccctggagttggggctaacttaagacaagatatcaaaagtaggctgtggccaggcccagtagcccacacctataatcccagaacttggggatgccaaggtggaaggattgcttgagcccaggagttcaagactagcctgagcaacagagcaagacctcatctctacaaaaaatacaaaacttagctgggtatggtggtgtgtacctgcggtcccaccagctactggagaggctgaggcaggaggatcacttgagcccaggaggtggaggctgcagtgagctgagatcacgccacccaccactgcactctagcctgggcaacagagcaagactctgtctgaaaataataataataataaaatatactaaattaaattaaactttttaaagtaggttgaccattccttgtggagaaacaaaacctatccaaatcctattcttcctacaaagctcacctcaaatcacaccttttccatttttttttttctgagtgtccttaggcatagtgatcattccttcattagttatgtataaacagtacattacggtggaaagaggcctggactttaatcagtaagtctaaattcacatcccggttttatcaactatgtgtccttagacaaatttcttaaatctttgaatctgattcctcatctcttaactgaaatttaatagttctcaatcccaaaggacagttgtgagaattgaattctaaatgtgtcaacatgctaaacacaaagtacatactcaacaatgttaaagtgaattttgttccattcattcattaaactctgactggattcctactgtatgttaggctgtgtgctagatattgggacaaaggaaacaattactaatgataccacacacaactgccatctactaacttctcatgtgtatagccctcaaattagaatgaggttagagattatgccttgtagctcttcatatttcccaaaagtaggtggcatagtaccttgaactcagtagttacaaaagtacttgtgaacaatttgattaaaagatttctacatacaggttttcacatttgaatcccaaagccaagcaacagcatcatcacttttaaagcatagctaaaagcacactcacttgacagctcacatccattcctgcctccagcagcacctgcacgactgctttgtggccattgcgcgcagcaaggtgaagtggcgtgtgcttgcgagtgttgcagctcattaagttaggatgtgcactgatgatcatttttaccactctaagccgtccgtagagtgccgccaagtccaaaggtgtttccagcttgctatttctaattgtcgggtcagtgagctcttctaggagaacagcaactacttctgagtgtccatattgagctgcacagtgtagggcagtttcattttcattgttctaagacaaagatttttaaaaaggcacattttcagaaattcaatttgttatcaaaatcttaacacagtaatttaaaacctgcaatgctttgaaatgtaagttaagatttatccattttaacaagtatgcctaatggaattttatatttgataaaagtatctaggattcattgaatcaaaaaaaaattttttatatcactttaatcgaaaacaatccaacatttccctaaatcatatatgccaacttccaaaaatgacaaatgatttagccatgtttgtcagaggccctcctgggtccagaaggacagtgatatctgcatggtgcatcacatctttagacatttattaataagagagatcaaaacaattataacagacttttaatagactggctttccaaaagacagataagaaggtaaattcttggtaacaaaaggtttatagaaaggtttcccaaattaagtttcattttattttccatgtaagtacaaatcattgcttcctttgcaaagaaaatgaaaagattttggccttaagatataaaagtacctttttgaaatgttatcatgggttgtgaggatggacctagatcagttcccagacaagttactaggagtatcacagtacaacatgtgcagcttataagggttcagttgaaaatcaatgagattttcctagaaatgtatcaagatttttaaaaatgttaagatacagaaaactgaacccagttgcaaggcagagggacccttcagactatttgagcaatataggtagatggtgtataggtatgtcaggaggtggaagggtcaggagaaaaatgaacaagaaattttagtaacaaaaatgcaataaccgtaaatgagggttctggaaagaaagagcagctgccaccatcagagttatcatcatagctaacactatgtactagacatagttgcattttatatatgtttactcatttaatcctcattatgagatagatactattatcattatctccattttacagatgagaaaactgaggcactgaatagttgaataactggccttccgttatacagccatttagtggtaggaccgggatttgaacacaagtagccaagacccaaagtgggtgttcttaaccatcacacataccaccttccaaaataggaactattactactactacttgttgagtgcctaaaaactatatatattgtctcatttaactcttacaacaattctccaaaatttatattaaaattgtctacttcatggacaagtaaactaaaatacaaaaaggttaaattacacatccaagtagaattaagatattttgcaagctggatctgacaaatccaaaacccatgctctttccactataccatgttgtctgccatgtgttgctatattgtcaaagaagagctgggaattagtgatctgaaagcagaatttctagaggttttgctcagaaaaataccaaccgagaatagggagtagctgtttagatagctgttctgatgaaaataaaaggataagaagtgttcagacccaaacaaatcttaatgttctagaaagtaactcaagtttgccctggatgatagaagaatgcaagtaagttgagagtctagagggaagatttgaaaatttaaaaaggagtagagtgacaaggggaaaacagcactaggaaaggcttcttactactttaccttgcaaataagtatcaagagagagcatttgaaggtcaaacccacagggaaaaatctactctttcaagacaatcaatgaaaagttaagacctgttagatggggaatccagctgagggtactgtttcttccatcatttgtcaggagtccttctttacttggtttgaaagtattactataatctacttcttcataaacaatgatcacatacaggtttagactccctggtcttcttatctgtttttcttatcaggcttataaaacagccaatcttattacttcacaccatgaaaacattatacagatatatacctcctgaccaacccaaatttccccctggtctgaaagggattcaatctcagttttcaaaatacagtatctctttgagaaaagagaaaggccagttatgaaataatgattcctcaaaggcctctctactggtccagagccctgagcctaggaaattacaagagcaaaatcgaaaaattttctagtaacaccaattagcactgttcagatctcaagggaaaatatatcaatcattcaagacctactcaggataaaaagttcacagattttatccatgatcatcacatacttggatcgtcacctcagtggacgccacaacggtggtacttttacgagagcatgattgtgtatttgtgtatgctcacaagtgatctaaaataatctaatttgaaataaataggctgtgatgaggcactgattaataattcctagtatggctatgcagaatattcttaaaagttttttaattccttcttttttaccaaatgggtattctctgaaacattaggacccttccagataatggatgatagaacaaaactggctaacaaaagccatttaccaaaaactcttggttcagagtaaaacatctaacaagagttggattcgagtttcggtgaatggcaaaggcaatgtgtttttcagataaggcccctctgggttttgccctaatgttaaaataaagaaaaaaaaaaagaggaagagaaggtaaagggaagaaaggattaatgaaatttaaagaaattgaaaattttcaatttaaaggaaatttaaattgcaaaaaggaaataatcagatgataaaagagaaggatgtggcaattataaaaaccataatccgggtagagtccactttgtttagaatggtgaacaagacctaggttgaagtgttaccatgtaaattacttcatctctccaaacctatcttatctgtataatgagaatattattttccctataaaccttataatatagtttataaaccaaaagagataacatatttttaaaatgcattgtaaactttaaatattaaaatgtagaatagaattatttttaaagaaagctgtattagaaaccaaagataactttcagaaatcagaatgaagccctgactataatgcataattttaacataacataaatgtattactggttgagagcttaggctttggatcagaaaaacctgcgttcaaacactggctgcatttcttagtagctgtgatgttacggtcaatctactctatctctctaaggctgtaactccatatatatagtagcaacagtaatctagggcttagtaagataacggggatgaagtattttgcacaatgcctggcacacagtaaacaatccattaagtgataggatttaggatgacaataccaatgcgctgttgtgtaaaaggctctggagtcaaagtcctgagtctcagtctcagtttcagtcactcagtaacacgtggccttcgacaagttgtttagttttacagagcatgatttctcaactataaaatgcgagtgatattatcaattcagaggattattgtgagaattcattaaatcgtatttttgaggtgaaagtgtttagaacagtgcccgctttaccttatgtctcaataaatgctaattaccatttttatttcctttattgtttaaatacataaaagtttataattaacaagaagattctgtcctattcagaaggaaaaaagaaagctaaaattaaaagttatctataaaaataaaaatcctacatcaaaaaatttaggagaaatggcatagaatgggaaaactatgatcagcatcaaaagagtatacatataacaatgaaaaaatactaaaattatggtattaaaaatcgtaagaaagttgcaacttcttgccaatagaaaccgcaacacaaagcaacagaggtgaacaaaggactttgaatatggtctccttaaaaagacactttttgtaatttaattgatctattcaacattaccaaaaacaagtatttctctttaaaacatatagcaacttttcactttcaaatgtaagtgaatactatatgttatttcttattttcatgtcatttaaaaacatcttgtttgtaaaaactaacatcctcttgtttaaccttggattgtttttccattttattatttcaggtttgctttgcagtattcagacaattttaagaataaccaccagatggctcatctcataaatgatctaactgttggttttctgtggaagagaagagcattgtcataaatttccttttagcatgatatgatgataaagatagccatatctgtcatgttttaaagactgggtgcattcttattaaaatttctgcatttttgtaacctgtaaacatggaaatttttattgtgataaatattaataagatacttttccaattaataaaatgttttcctgattagtcctttcaacaactgcatatatattttcattgaaaaaatatgtatttttcttccctttgctatttacagcaattgttactttttatccttcagtctgaatttcaaagtccggcaaagtctgcatccatttgaacaatatgctaattgtgctttattagatatgcttgccctaaagtaacctacttgcattgatattggacaactgccaacctgcagcttaatgccgtgattgtaattcaattgttggactgtctgctggttttcaaatatagttttacaaaatgggaacagtagggggcatgcagagatcaacatgtttgttatcatactgtattaggggaccatattttactttctagaatctgtggtcctatctgtttagaatactgacactggttttctttttaaaatatgtccattatgtgtaatatagatattgtgtacttacaaatacattaactgtcagaatcatactgctgctgtgttttattcaacttattctgggcatatgtgtttgtgtttgtatatatatatatcaaaaaattttaacttaatatgtgacaagcaactgtatatgctatatttcacattttgattcacaagagtacttaaccatgaaagtgctaagtaaatggtaaagcattatgcaaatgataggcatatcattgttttagcattcaaaattgtattaagaaacattgtaattctcattacacatatgaattctgttctatctttaaatattcaatggctataaaatggctgattatataagacaggcaaaaatatttcagctacttcctttatgtaggattttcccattaacaaagtatctttacaaatgcccaacttagtccctgcatatcatatccaaacaccaaagaatttttcaaatttctccttttaggaaattcagcaatggaaaggcctttgggcaaggtaaagataaaaaaatcacattttcaatatggctttgccttgtaaaactagaaaaattacatcatgagcaaacatttggcaagtgcacctgttcattgaccctggaatgtgatggtccatgatgaataagaatcttcacaatttccacatctcctttccaggcagccaggtgaataggaaaataccctttgttgtctgctacatttgttgatgcctcatactgaagtagtttgagaactatgtccctaaaaaggaaaaaacaacaacaacaaaataggctgagcaagacaaactgtattaaataggtaattttaaaagaatactagatgctgggtgggaatttagagtaatcattcaaggtactaagatataaagttgggtttcaaagtttttgcctactcaacatttggctattttacttacctggaaaaccatcaccccatgccacacacacacacacacacacacacacacacacacacacacacacacagagagagagagagagagaaagagagcgagagcacacattgactaaccaattaaactacttaatagaattcatataagcaaaacttaacttatttcattaattagatgagctaagtaaaatgaagaggataccaactcccatttttttttttaaaaaaagagctctttccagatagcccatatctgagatttagtttgaaggaaaagttgaagttacaagtatattccttgtttacacacacacaaaaagttatcataataccaaggaggcatttataaaatttacacatcattcctacagataattggaataagagatttaaggggtatgtaaaagagaaagaaagtgcagtatgtaagggacccttgacaagctaactgtagtactagcccagggttaaaaaataataataaaaaaattttaataacttctcagtgatggcacacaacacactttgagtattccttgttcctacttctgtattccttcacctttcttctccaagcataaaaaattatttcaaaagggaaactcatttaaaagacaagttccaccattaatgcaatttcaacacatattcaatatatcctacctcaaaaattttgaacttaatccccaccaggttttcaaagtaaaaatcctgacctgcattactcaaccttagaaagaattaattaataattattagcataaattatatcaaaatatatgtcaacaatcaaaagcagtaattctaaacaaaactgtattttcatttggatgcatttaagaagcaaattctattaactcactaaatgaaatgctagtcagacacacataaataaaaatatatatataattacaatatataataaagttgtttcttacatacaacaaatcactaatggggagggtgaacataacagatttacatttaaacatttcataaaatcagactctagatgcaagtaacaaatgaaaacatttggaggaaattttaatagaaggaagattagaattttgatagctcacaagaaaaacagatatgatatgatacaaaattatggtaaatggtaaaacatactgtccagaatgtgtcctaaagtcacaacatttgacttaattgctaaatgtaagaaatcatgattttaaaaaaacaagaatatgttgtagaaatatttagaatccaaggagtcctaaattgtctaatgatataatttctgagaaattaagaattaaattttaacatttctctttgaaaaaccagcattattttacgaaatctgaatttagaagacttggatttgtgtcccagctatgcaaactacctgaggctgtgattccggagaaatgataatcacacaccacataatgataattcgatcaacaacagaccatccgcatatataatggttgttcaaaaagattatcatacctcatttttactgtaccttttctatgttttgatatgtttagatacataaatactttctgtatctattgtgttaaaattgcctacagtattcagtacagtaacatactgtgcaggcatgtaactcgggagcaacgggtcataccatgtagcctaggtgtgtgacaggctatatcacttagatttgtgtaagtgcactctatgatgttcacacaatgatgaaatcacgtaattagacatttctcagaatgtatccctgtcattaagaaacacatgactgtacttagtctcattttctttttcttcaggagatactataatgataatgtctactcaaaactggtaatagcattaaataagatcataaaaaagaattcactcaataaatagtaaagcactataccaataatagcacttgtcccaagtaaaaataaaatactttagaagtgaaatgaaatgcttatagaaagtcaccttcgaaaaacagaatcagaaaatcagaaggaaacttaaaggttatccagttcacacgcttctccccatttccctgccaagcaagggttgttatatagggtcttccattctgacataaataaatacataacttcagtgaggtaatgagaattcaatacctatgaataacaaaagcagataaggaaagatctgaagtcccaactctctactatttacaaacctggttaccttgaggaaattaagtaacctctgtctctctttcagatattgtgaaaatagaatttagagattacatcttggtgctagtttcaaacagttatggtgtgaatcaaatgagaaacagatgtaattgtaaaattatatatacaatcaaaagttgttctcaaggcagattgttgcaatgttaaacaattccagtgattgctttttaaataaaatatttcagcatttaaaaggcaaaataatagcaaaagaagttagtcaaattaaatacctggatctaaaatgtagaatttagcctactacaaaatagacttctccaagttactgtcaaagacaactgtgagaagagaaaaatttcatttcttaatacctaaggaaataaaaaatatattctgaaacaacttctcctataaagcatttcctttcaaggggtaaagacgaaaaaaagattgatgggatcatcaattctatttccttttactcttgctccaatcacttagaatttcatttgttctttggctcaaattttactgacattttctaataatgtaagtgatatacattcattcttcatttatcaggaagatttatgacaagtgaaaaaacgtctattttgaaaactgacttactaatcatttgtattttctagtattaccaccatctaatatctaaatcagaaaagaataatctgtaagtttgtaaaattgcctttggaaaacactaagatcctaactacacattatttacacattatttttaagttttgaaaaatgtatttattttaataaataaatattttgttaaatgtgcttatttttttcttttttaattttatttcaatagtttttgggacacaggtggtttttggttccatggatgggtaacactttagtggtaaattctgagattttagtgcactcatcatccaagtagtgcacaatgtttccagcgtgttgtgttttatccttcactcccctccaaacctccctccaccagtccccacagtccattatatcactctgtatgttttggcatccacatagcttagctcccacttagaagtgagaacgcatggtatttggttttccattccctagtcacttcacttagaataacggcttccagttccatccaagttgccacaaaagacattatttccttctttttatggctgagtagtattccatggtgtatatatataccacattttatttatccactcattggcacttaggttggttccatatccttgcaaatgcaaattgtgctactatacacatgtgtgcatgtgtctttttcatataatgacttcttttccttcgggtagatacccagtagtgggactgacggatctaatgatagatctgcttttagttctttaaggaatctccatactgttttctatagcagttgtgctaagttacagtcccaccagcagcgtaaaagtgttcccttttcaccacattcccaccaacttctattgttttctttttttactttttaattatggccattcttgcaggagtaaagtggtagctcattgtggttttaatttttatttccctgatgattagtgacgttgagcactgtttcacatgtttgttggctgtctgcatatcttcttttgagaaatgtctattcatcccctttgcctactttttgatgggattatttgttttttttcttgcttatttgtttaagttctttgtagattctggatactagccctaatttgcaaatattttctcccactctgtgggttgtctgtttactctgctgattatttcttttgctgtgcagaagctttttggtttaattaggtcccatttatttattttcgtttttgtttaaatgtgcttattttaaaattaaaattaaaattaaaatttattttcaaatttttgtttaaatcgagctttacatcttattcaaagataccagctaatgaattggttgagctcagatttctagtgttaaaacatatttgtgaaatataaagttgtatccctgatcaaataagtatctgtcagttttactaagttataagtagaataaagtgttaatcagcaaattatgattaatcattcttatgatatatccatatatatccaaagtaatatgaactaaataggccattttcatccaggctcattagaacaatttaaatttcatatataatatctaaattagaagagcagttaatatagtgtagtaccaacttagtatttttattgatacataatagttgtatatattttggggatgcatgtaatatttttatatatgcatacaatgtgtaatgactaaatcaggataattggggtatccattacctcaaaggtttatcttttttttgtgttgggaacatcacaattcctctcttctagctattttgaactatacaatattggtaactttagtcagtctactgtactatcaaacactagatcttattccttctaactgtatttttgtattttaatcaaatctcttctcccccccccctttccttcaaagcctcctataaataccaattaactttctacttccatgagatccccttttttttagctcccacatatgagtgagagcatgtgatgtctgtcttcctgtgcctggctcatttcactttacaaaatgatctcatgtccatccatgttgctgcaagtgacaggatttcattcttttttatggttgaataatattctattgtgtatatgtgccacatttactttatctgttcacttgttaataagtaggttgatcccatatcttagctattgggaatagtgctgcaataaactggggaatgcagatatcactttgataccctgatttcctttttttttttggatatgtacccagcaggggcattgtgaaatcatatagtaattctatttttagttttttaaggaacctccatacttgtcgtccattgtcattgtactaatttacattcccatcaatggtgtacctgcattccccttcctctgcatccttgccagtagctattatatttgtcttttcagtaaaaatcgttttaactgaggtgagatgatactgtgattttgatttgcatttccctgatgattagtgaggttaagcattttttcatatgcctgttggtcatttgtaagtcttctttcgagaaatgtctataatcgtttgcccatttttaatgaaattatttggttttttgctattgggttttttagttccttatatgttctggctattaatctgttgctagatagatagtctgcaaatatttttttcccattctgtcagttgttgaagctgggaaaactggataaccatattcagcagaatgaaactagacctctgtgtctcaacaaatacaaaaattcagtgaaaatggattaaatatttacatctaagacctaaaactatgaaactagtaggggaaaacacctcaggacattggtctggacaaataatatttgggtaagacctcaaaaacataggcaacaaatgcaaaaatagacaaatgggattacatcaagcttaaaagcttctacacagtatttctttaaatattatttaggttgagccttatagcttactttaaggtatccacaaaggaacacatcgcctgtgcttggtcaactggcatgaaatattcagtcattgattgatgagcatttgggttggttccacgattttgcagctgtgaattctgctgctataaacatgcgtgttcaagtacatttactaatgtaaccaaatatcacctggaccacaataacttattgaaaaattaatgttaaaaaattcattgggactgtgaaaaaagaaatattaagttacattgctaatcaatatctgtaaaatagcaagcagcaaaataatccctatgtcttaaatgtaaagtagcattttctgatatccagcatttgacaaataacaaatactctaaaatcctaaagcaaatgtggttgacaagaaaatagaaaaaatattttggaaaatggaaatagaaatggaaaaatactttccatttcccaaaaacaaagtaaaacatcaaattaaatttaataatatccaatgtaaatagctgcaatattttgcagctttaagctaatacatgtaagttcagttaaaaacaggaattctagaagtattgacttttgctgctatatttaattcacatccattttctgaaagatataaatacacatctgattaataaaaaatgtatttcggtaagttcagcatatgctctgagcaaaattaaataaattgggaagagtcaaccttcaaatttctttgcctcaacagcaagattccctgtaattaaatcacaaccaaagatgtttatttcataccatcctctcttgcttgttgattgagtccaaagaatttcaaaataaatgcaaatcatcttcatatggatgcagaattaacatctaatgaaactctcaaatttaataaggtccttttgatttcagattttcttgacacttttacttctctttaatgggaataaagttgcagatgtgttcaagatggtcaaaagatttcaggacaatacgtcccattttctaactgaagtttctttacatgttgaattcactctcatagatttctagattacagagtgaataaaggcaaattttaagtagtctgtatccttatccaggaaaaaaagcaagatgactaaagatgtttctagttattcaaagagcaacttcagagaccagattatacaatttttagaggaggtatgcctcttttattagaaaacctaagaaagatcaaatcatacagatagcttattatatggattctagatccaatttgatacgcaatctggattacagataatgagatctagcatgcattaaatactttaaaaggtagaagaatagaaaatatcttatgtgtatataaaacaatatacatatttcagaaatacaataacgatctgctgatatttttcaaaacagcatgcaagtgtcacaatataccaaatatagtttaataacattaaacttaagaagaaaataaggaactatttgttaagtagagaagaaaaattgaattgaaatatgagtatacaggtttaatataacctcacagggaaagataagattattactaaaaataatggatgaaaagaagagaggagaaaagtcagaaagaaggaaaagtaaaggaaaaaggaatgaggggactaaggaaagcagaggagaacaagaaaaaaagggatgagaagaagtgggaggcagggaaggaaggtagagaggaaggcaggtagtcaggccagccaattgcttttcagaggagaattaagggatttgaatttgcagtagaaatacatgtgacaatgaatcctccatattttaaaaagagaaaaagatacaaagaaatagctctctactctatctatggaaataatttataatacttgcagtaaattttgttttattaaccatgattttttcctatcatttgatggtaataattttctaatctgtgattacaaataacccaagaaatcaccagtagagtacattttccattgtgtcctgatctggctaattgaagatgaatatgaaataatgcatttcaggtacaaaatgctgcttcatttgtggattaactagcattgataaacaatggctcccaatgaaaatgtacaaaattggggaaactggtttaattttcagtatgaaggctttagattttatgttgggggtagggggacagtttgtgttcaaagcaaaagaataaactatatgatcccgaaacattactgctggctttatgattctatgaactttagcctaccaattataatgtttatggaaaaaatctagagcagatggatacaacaacagcgacaaacatggaaatgatgtgtttctgtgcagactgctaaggcttgcttgggaagaatacaatataatcattgttagttacctctgctaagtgagaatgcaaataaaagaaataaccttcttctctggctctgagatacagtctatgacattattttctccctcaaatatcttttaagccaatattaaaattagcattccatgtaaacatatgacaaatgattatgggaggcaggccagaaatatataatgtgacagagaagagccagggagagtttaacaacaaaggggagataatgcagagtactggtaaaagcatagacttagaaccagaacacttaagctctagacacaaccccactttaatatctatgtggccattaagtcacttaactaaatgggcattgtttctccatctataaaatgagggagctgaggggtgtcaggtagaaaaagtgatctctaactgtacaagttcatagattatttaaacttgcaaaatcaagaaacatacactctatatgaaattcccaatttcagaactgtagcatcatagtgcataactgagccataaataataccaacacagtgtatcattcaatgttatcattgtaagaaacaatggagaatatcaagccaatctattcaagctattgaactgaggcctacagatgttaagtaaatggttcaaggtcacacaactagcagagatggggagatggggttagaatcttcctgctttttccaatgcctataggatgacactgaaaattaaaaagaaaagataaatgagatctttcagacaaaagcacagacatataattcccacagactatctgtaattaaagggatctttaaaaatagctaatcaaattatctgtttgtgagaatcttaatgattgctattcaatttgcttaaattatctttattttctaaatcaccaaaaaaaaaaaaaattatgccatgggccatagaaaaacatatctcaacagttagaacttcatagactgtcatgtataaatcagcatttactaaatacttcactgaaaatgaaggagggatatgaatgctaatccattttgggacaatattactttaagaagtgcttacctaccaatgccaatctgagaaagaacaagaaaagtagtatgcctcaaatgaaaggtcaggcccaagatatcctgcccattagatgtaatagagtttatcttcccaattagaactaaaaaatatgatagtagcctgaatccataattcagatagccaagaagccatcaggattatattacttgggctgatttgtctttgttcctggtgactcaggtaaaaaaagaataacaacattctcctttaaaatatttagatatctggacatactttccattctataaaggaagagaaaaaattagaagatatggcaaaatatttctaaatgagatgatataagacaatatagaataggaactgaataaaaataaatacaatttgggaattccaattctaaaaatctaaataatgaaacaaagtttataatagtttatgtaactcaaatgattctctaaacaggctgatggcattaaatttatacattttaagagaaaaatgtcagtgatcaataatgacaaaaaaaatgtcttgcattaagagctttatgaccaccaaacctaagattaagtatgaagaagacccttgagtcaccattcacagaataaaagaaatgttaggtgaaaaaacaaaaggtaactaccatttctactttttaaaaaataatttcaacttttattttagattcaggggacacatgtgcaacttttattttagattcaggggatatattgtatgatgctgaggtttgggatacaatttatcccatcaccttgatactgaggatagtacccaatagtttttcaaccctccctaccccctctagtggtctccagtttctatcattgccatctttatgtccacaagtagccagtattaagttcccacttataagtgagaacatgcagtatttgatttgctgttcttccattaattcacttagaataatagcttctagctgcatctgttgttgcaaaggacacaatttcattcttttcatagctgcatagtattccatggtgcatatgtactacattttctttatccaatccaccactgattggcacttcaattgattccatgtctttgctattgtgaatagtgctgcaatgagcatgcaggtgcttgtgtctttttgatagaacaatttactttcttttggatttataccctgtaatgggaatgctgggtagaatggtagttctgttttaagttctttgagaaatctccaaactgctttccacagagactgaactaatttttacattcccaccaacagtgaataagcactctcttcactctataaaagatgccaacatttgtcattttttgactttttaataatagccattctgactggtgtgaaatggtttctctgtggttttgatttgcatttctctgacgattagtgatgttgagcattttttcatacacttgttggccacttgtatatcttcttttaagaagtgtctgttcacgtcttctgagtactttttaatgggattatttggtttttgcttgttgaattctttaaattccttatagattctgaatatttggcctttggtagatgcatagtttatgaatattttctcccattctatagtttgtttattgatagtttctcttgctgtgcagaagtgctttagtttaatgaaattaggtcccacttgtcaattttatctatttatttatttatttttgagacagtcacccaggctggagtgcagtcatgagatctctgctcgctgcaacctctgcctccagggttcaagcgattctcctgcctcagcctcctgagtagctgggattacaggcacatatcatcgtgcccagctaatttttgtaattttagtagagacagggttttgccacattggtcaggctggtctcaaacttctggcctcaagctatccacctgcttcggcctcccaaagtgctgggattacaggcatgagccactgcacctggcctcaatgtttctttctgttgcaattgcttttgaagtctctatcgtgaagtatttgcccagttctatgtccagaatggtgtttccaaggttttcctctaagattcttatagtttgagatcttacatttaaatcttcaatctaccttgagataatttttgtatatggtgaaaggttaaggtccagttccagtcttctgcatatggttatccagctatcctagcactatttattgaagagggagtcctttctccattgcttatttgttatcaattttgttgaataccagatggctataggtgtatggctttatttctgggttctctaacctgtttattggtctatgtgtctgtttttgtaccagtaccatgctgttttagttaatactgtagccttatggaatagtttgaaatctgctatcatgatgcctctggctttgctctttttgcttaggattgctttggctatttgagctctttttttaaattcaaaatgaattttagaatagttttttcctagttctgtgaaaaatgacattagtaatttgataggaatagtacggaatctgtagattgtaactagcacttttaaagcagtaattaccacatctaaaagactaaagtgagggccaggcgtggtagctcacaatcggcactttgggaggccaaggcgggcagatcacgaggtcaggagttgaagaccagcctgatcaacatggtgaaaccccgtctctactaaaaatacaaaaattggccaggcgtggtggtgggcatctgtaatcctagctactcaggaggcagaggcaggagaataacttgaatccaggaggcggaggttgcagtgagccacgattgtgccactgcactccagcctgggcgaaggagtgagactctgtctcaaaaaaaaaaaaaaagtgaaatgaaatgatacagatctgggaaaactaacttggatcattcacacaaagggaaaacagagacgagggggagataaaggaagagggtcattttttttctgtaggggaggacagaacatctgaatcatttggaggactcatcacactttaactctgtcactaaaccattaggatacctagctaaaatactggaaatagagattgttacggctacacactcttgcactctccataacatatactattacattatttgaaacagttttacttattaaaaaaatttagggttggcaaatctaaaactagaaagacaatcatgaatgacaaagataaaacattttagctaaataaggattctgaagtggttcatataagtgaccagggctcagaatagtgggagtcatgctaagtttacactcctagtaaacactcctatgttgggtgaatacaaggagacaccaaaaaaggtaaaggggtgttatcaagtggttttatcccattctctcccccaaagatacacatgactagcatggtcctgtcaatttttccattctcccagtgtgataggttgagtattttagagcatttctttcagcttacactctgcacgcaattatactcagcaacattcctaccaagtctaacttgtcagtgttgtcacctggtccctttccaaattcacctaagcccattggactcacagagacatgagaaaggtatcgtcaagacataattaacttcatcacatgtaactaaatacacacgattccgtccaaataagtggcacttacttatgtccatttaaggctgcgtggtgtaaagcagtgtaacccgaactgtctgtgcagttcacattggggcctcgccagatgctgcaaataaagcacaagcgcagagttaacagtgaagccagatcttgccttgaaaaacaaaaagaaggctggtagccccacagtcagcagcaggttgtagataaaaattttagccatgtggaaaatgattgccatcttctatgaattcccctcagaacatcaacttcatttatttgataaaaggaaactaatagagaatgcaactattaatatcttcagaaattattaacaaatgtgtgtccatggtcgtgcactgaagtttggatccaaaaattccctattactttctatcgttacttaaatattagaagcaactaacattcagctactatattccataccaaagaataaagatttatgagacctgcctcatgcctgttaacacactccttctgaggtgccggtgatttatataagttataagatatttttgcattgtgggaagaatataaagtctttttgctcttcaattgcaaccaggaaaatgtaatcaatatttcatacttgaaaataaaattgaagatttggactgttgtaaaccatgagaagatcctaacaattttgcagtcatcattgattttactatgcaatatattctggagataacatgtaactatataaaagagtctattttttttttgataactacaattaaggaaactctttttaacttttggaaaataaggcactgaaagacacttttccaaaaatagaacaaaaaattgctttatctgatggtcatagtgatatcaaaactatcaaagataaactagttcacacattcacaaaacatttattgtacaccaactgtatgtcacatattgagctaggcactgggagcacaaaatcgtaactcaaggtccttctttacaagaacatagtgtaatggaaaagatagacacacaagctaataattacaaagtggtaagataatcaaggtaccagacagcacacaggcatctctgaaaagagaatgaatagctattccaaacaaggggtcatggcagacttaaactaaggtgggtcaatgaaaatgaatggaatgtgcttatttgacagttaattaaaagaagaattaatgaaacacatggatcaattggaagaaggtgggaaactggaagcagtagtctagagatgactcagactttaggcttacatgactagaaaaaattacaatattaactaagatgtgaaataaaaaaagagcaaaatctgctgcagggaagacaatgcaggatggagagaaaacaatgactcctagtttgcagacgttaaatcttaagtctctgacttacttacattacataggttcaatgcaatccctatcaaaatcccaatggcattctttaggaaattgaaaaaaaattctaaaattcatatgaaaccataaaagaccccaaatagccaaaacaattctgagaaagaaaatcaaagttgtatgccaggctcagtgactcatgcctgtaatcccagcactttgggaggctgaggagggaggttcacttaagctcactagtttgagaccagccttggcaacataacaagactccatgtctgctaaaaataaagaataaaaaaaattagtcaggtgcggtggtgcacacttgtggtcccagctacccaggaggctgaggtagaagggttgcttcagcctgggaggtcgaggctgcagtgaaccataatcatgccactgcactccagcctgggcaacagagcaagaccctgccacccccacaacaaaaaaaagaaagaaagaaaaatggaggcatcacacatccagattccaaattcaggggatatatatacatacaataaaatattattcagccctaaaaaagaattatatctaaacattttctatgacatgaatgacccgggaagacattatgctaagtgaaataagccagacacaaaaagaaaaatattgcctgaaaatatacggaatctgaaaaaaaatcaaatatacagagatagagaacaaaagattggtagggggagtagaacgggggaaataaatatcagaggatacaaagtagcaaatatgtaggatgaacaagtgtagaggtctaaagtacaacatgaagactacaggtaccaaaattgcactgtatacgggatttcagctacgtgagtagattttagctgctcttgccacaaaaacaaaaaataaagggtaactctgtgagaggtggtcatttgtttcactgtagtaaacttttttttactatctatatgtatcccataacatgtgtataccacaaatatacacaataaaatttatttttttaaataccacaatgacatgctactatataactatcagaattgttatctttaaaaaggcttcacaaacctatattgacaaggatgtagatcaaccagaattcacacacacactgctaataggcatgcaaaatagtacaaccacttagtgaaacaatttggcagtttcttaaaaagttatatacaaataccacacataacttaccatcaaatcataccatacaaataacatacaaataccatataatccagtcattccactgtaggtatttagcccagagaaatgaaagcatatgtccataaaaagacttgtacatataatattaataacagctctataggtaatagcctaaaacagagacaacccaaatgtccattagctggtaaacagataaattgtgatatatccatacaatggaaataaaaagaattaaatactcagaaacaaaaggaattaaatactacgacattggttgaaaatctaaatcaattagattttctcaggaagaacagcagaatggctgcccttcaatctccccagcagaaagggagacattctctggcacagataaaatgcatgatctctggactagacccctgattggtagccttcatcaacttctgtgatgtaaatacttcaacttaacgcagtgataggaagagatgctaacaactgcacttcacaagcagacacaagccaatccagcacaccattcaaaggcctacaaccaacaagtcccaacactatgaactcagagcttcccatgagtttttgaaaacctccactctcaaatatgaacaaataaccaaagacatccaatcacttgaggaaagcctttactactaaagaaaccaaaacaaaaaattaggaacaaactacagaaaaaaaagaaacttagagaaaatttagactatgcatggagaagaaattttcaaaaacagttatcattaatatcatctcaatattagaaaagataatgaatgtaagaacaatgaaataaaaaagaaaatcagagataaaatcagtagaagaattaaaaataaagctgataaggccaggcatggtggttctcgcctgtaatcccagcactttgaaaggctgaagtgggcagattacctggtcaacatagtgaaactccatctctaccaaaaatacaaaaattagccaggtgtggtggcgcacgcctgtagtcccagctacttgggagggtgaggcaggagaatcgactgaacccaggaggcggaagttgaagtgagtcaagatcgcaccactgcactgcaacctgggtgacagaatgagactctgtctcaaaaataaaaagtaaaaaataaagctcatgaagtatctcagatacttagaaaaaaaaggcaaagatatagacaaatagaagggaaatcataagaaaagtaggacaccgatttagcagttccaatattgaaaaatagaggttcttaaagtcaaaacacagaaaacaggagaatgaaaacaatgaaagacatcattttaaaaattatcagaactgaaggacattaatttaccaaataaaatgtacatgggccagtcgcggtggctcacgcctgtaatcccagcactttaggagaccaaagtgggtggattacccgagtgaggtcaggagtttgagacaagcctggccgacaaggtgaagccttgtctctactaaaaatacaataattaggccgggcgcggtggctcacacctgtaatctcagcactttgggaggctgagtagggcggatcatgaggtcaggagatcgagaccatcctggctaacatggtgaaaccctgtctctactaaaaatacaaaaaaattagccaggcatggtagcgggtgcctgtagtcccagctactcgggaggctgaggcaggagaatggtgtgaacctgggaggcggagcttgcagtaagccgagatcgcaccactgcactccagactgggcgagagcgagactccgtctcaaaaacaaacaaacaaacaaaaaatacaataattagccaagcgtggtggtgcatgcctgtagtcccaactactcaggaggctgaggcaggagaaatgcttgaacctgggaggcagaggttgcagtgaggcgagatcacgccagtgcactccagcctgggcgacagagtgagattcggtctcaaaaaacaaaaacaaaaacaaaaaaggaccaggatagctttgataaaaaataaaaataaaaaaaagacaaagaaataactgaagtgagtccgatacggtcttttaaatttcaattaaacaaacaaaccaaattcctaaaacacccatccagggctattctcttaatttaaatttttcctctttcaactctagttacactaacaagtcttcactattcaggaaacctagaatgaagagaaattattcatacctattacttctacttcaatctgcaatcttcaattattaatggacactctccaagttctaagtccaagaaaatacaagtccaagaatcaaacaaaataatgaataagatatcatctcttcctccaaagagctgacaatctaatagagaaaaatatatacagataaattacaatataggcagtgaccatagttcctacagcacagaaaacacctaataattgtttgttatcaatcttcttgttcttattaaataaatgctacaatagaaaaatctttaactccctaaattaatacatctgttcaacaaaaatctctatggaatattttacggaaaactcaactaaaagttctaaatttgatttagaagaatttacgggaaaaaaaattgtgaaacaagaagtaataatgggatctacatactaccaattatgaaagcatatcataaaacaataccaaaaaatgttagtctagcaccagaatagagagctcaatgaatataagagaagccctagaaacaaaccagtcatacatataggaataaagctgacatctgaaagaagcaaaaaaaaaaaaaaaggaaaacatcattcaataaatagtcccgagaaatatgttttaattaatgggaaggaaaaaacaatttcaattccctaccccataccatttagcaaaatttaatccacatgatttgttcttgacttctcaaacctcattcctaccctctttttctcacacaccctgttcaaaccacacaggcctccttaaaaatataagtatgcttgcaccttatgactgttgcatttgaaattctctctgcctagaaagttttttcctcaatcatatggctcaatctttctgctcaaatgtcatctcttcggaaactctctccctaattattcagtcaaaaatagcaccctatcatcattctctttcctcttagttatgggacttatcaccatctggcattatattatttatttatatgcttactgtctgtctccccactagaatgaaagctccaccacactatctttgggtcttaaaacagtgactggaatattgtaggtgaccagtaaatatttgttaaatgaaatataaaaatgttgagtacatatatgaaaaatgtcaacctcactggcaatcaaagaaagcaaaaaaaaaaaaaaccaaacccataccattatatatttctttatcaaattgggaaaaaagtcaataatattcagtaatggttagcatgcagagcttataataagctggtggtgaaaatgtaaattggtacaatttttctggaaggcaatttgacattacatgtttaaaagctttcatagtgtgcaaatgtgttacctagaaattctccttaagaggaattattttaagaaattaattaatagtttgtacaaatatttagctataaaaatatttatcacagagtgagggtagtaaaaattatggattttgatatataatgccacttagaatagttattctctctttgctcttgtcagctagatttctaacactgcctgcctccagagcttagtactcatctttctctctagctttcttatatgagacccacagcatcagtgtcttatatggctccagtagcatatggcttgagctcctactgatcagggttttttttttttagcttatgtgaacctccctgggaggagaaagtctaccaacagagtagccagggatcctagagaggacgcaattcttcttagttttatacaatggctcaatatatgtgacagataaacagatatcactattctttaacataaaataaaaatctcacaacaaaatggaaaaacaggatattaacaggcaattcacagaaaaggaaatgtgaatggctaataaatatttgaaaatataattaacctcactgtggctagcaaagagcaaaataaaacagtggctgcctacttttctaccatcagatgggcacaaatttttaaagaaataattgataacaatcaatggaggcaaatatgtgaagaaatagtcactctcacagaatattcattgaagtgtaaattgctacaacattcttggaaagtaacatggcaatacataatcaaatttcaaatatgaatactcttagacccaacaactccacttttcaggattgatatctatgaaataaaaatattcatatgaagactgcagacacaaaaatatacactgtagaattttaatagtataaaagagaaagggtctggaatggtggctcatgcctattatctcagcactttgggtggctgaggcgggcggatcacctgaggtcaggagatcgagaccagcctgtccaacatggtgaaactctgtgtctactaaaaataccaaaaattagccaggggtagcggcgggtgcttgtaatcccagcactttgggaggccggggcaggtggattacttgaggtcaggagttcgaaaccagcctggccaacatggcaaaaaaaacactttactcaaaatacaaaaattagccaggcatggtggtgcatgcctgtaatcccagctactcaggaggctgaggcacaagaatcacttgaacccaggaggcagaggttgcagtgagccgagatcaggccactgtactccagcctggatgacagagagagactccatctttaaaaaaaaaagagagagagagagagagaaagctcataaatgcccagcaaaaaaaaaataaaaaattaattagtccaatagctgagaatggggcaaaaaaggaaaagttaattaggattcattcacactatgaaatgttatgcaactattaaaataaataactttgatctgaatgtattgactttgaaagtcagccaaaacatataaagtgaaaaacgtaaattgcagaatattgtgtgtgtctggagcattccaaatgctttatatgcattagcttatttatagccacacgactataagaaagttactattactattcccattgtatagatgaaaaatatttgcaataacatagaaaaatacatgcaaaaatacattattcattctgtgaatagtctgaatgttgaaattatcatgaatttctttaaggaaaagaaaagacaataaactacaaaggaagaaagataggtttgctccagattacgaagaacctcataatatattgaaaagcttggattttattctgcagcaacttggaactaaatggctttcagaaagataagtatgttcctcacatgatcagtcagtgttttagaataagagctcttgtaacaggtggaaggtaaacagagtgagagtcaggttaattgttttacagaccaggggagaaacaaagcaatttgaacaaatgcagatatagtggtagagagagagagggtgagaaaattcaaattgatatgtctaaaataaaacctatgggagatggtatccatatgaatagaataagaacaagagaatggctgaggtttcaaccatgaacgaaatgcatcaatgatgagatatctccactagaaaaagctgcaagggcagtagtatcttctggcaggagccaagtttcagttaaaactgattagaacactaggttgcttggagtacctcaggcaaaaaatggaaaagaaataggaaaatactgcaaattaactgtcatacattttttaaatttctgcatgttattagaccttacaaatattttgtaagagaagatatttataactaaaataagattcagggcctatagatttcaattacctataccaactcagttccccattatacaaaaattaattataatacacacatttttaataactccattgaatgtcgccttctcctagcaaaatggatatggatacatcttttttaaacaaggaggtttagaatggaaagttagcatatatctaaatatattcaactgcacctattgacagagcctctaggcacatatccacatatccatagaacatccaccgacacatctgaaacaccataaataagccagacccaaaccctccaactaaaaatttaatttaaaaaagaaaccttgatttctaaaaggttctgcttcattccaactttttatattgccttgccccctttactcaggcataatcttcaaatttagaaagagggcctagattaaaaacttgattaacttaagcttgtttcataaaatgcaagagtttctagacacatttaagaaatgtcttgaaaaagtataaaatgcttattacatatttattccaaaaaaagcaatttatagatccttggtcttagtctaatacacacccaaatcccatttcttatgcctacttgtcaatatcttaaattctgtatgtgagaattactgcccaaaatgaatgttctcagacaatatggggttgccaattaccaaaaatttaatttcctttgttatattatttgcactaatgtaacaaatcagattagtagattttagaataaatataaacaaaatagttttctaccaaactttcaaataaccaggacattcattagtcagaatattctattatctaagctttcacatattaaataagattattcttaaaccataagcctgagtttcttaggccaatatccatatgtacagcaaataagatttgaagcacaactactccacaaattgatcattattataccttccatcagtctatggggaaaatctatcagaaataacataaaactgtttcagtttttattgattcctatctgacccctgacacatgagatcacgccgaggcatcagatatggaaattcatacagaatgtgcatttaatgcctcaggcagggtcagagtatgtaggaatggtcttctgacagatcatatcatttcaagcaatgcaaaataaaccttattctcaatctgtgtcttaatagtttacttccatttttggatgaactggacatatgtacatatgctactgattactacaagtgaagttctcatcagtttagtgatggcacaattttattatcatgggctacaagtgtcccacatgggtcaaatgggtctatatcagcactgtcctttagaaatacaaggtgaggactgggcatggtggctcacacctgtaatcgcagcacttttggaggccaagacaggtggatcacttgagcccaggagtttgagatcagcctgggcaacaaggtgaaaccccatctctacaaaaaaaaaaaaaaaaaaacacaaaaagaaaaattagccaggcatggtggcatgcatctgtagtcccagctattcgggaagctgaggtgaggattgcttgagcctaggaggtggaggttgcagtgagctgacactgtgccactgcactccagcctggacaacagagcaagacccagtctcaaaaaataaaaagaaaaaaatatataatgtgagccatatatgtgaatttaaattttctagtagccacattaaaaagatgtgaaattagtttgaatatattttatttaacctagtatatcaaaaacattatttcaacatataatcaatataaaaagtattgagatgtttcacattcttttttgtactgttttcaatattggtgtttattttacacttatagcacatcacaattaggactagccacatttcaaatgcttaatatcctgatgtggacagtggctactatattgcacagcacagggcatttctatataattattccaaggggaaaaaagaaaattaactctaataatatgaaaaagctttctagtataaggaagagtagctaacggatgctggacttaatacctagaagatgggttgatctgtgttacaaaccaccatagcacacgtttacctatgtaacaaaactgcacatcctgcacatgtatcccagaacttaaaatattaataaaagttgatgaaaaataaataataaaaaagtattgtcacattggaacccacatactatcccatatgagtttattgaatgaatatttactgaaatgtgcaaaaccatctaagtaagatagatatacactataaagcttaaaaatgcagagaacaactatgaactggccttctgtgaagaatgagaacaagaatcagcaaactgtagaccatgagccacatccagtccactgtttgtttttgtaaataaagtttcatcgaaacacatacagacacatacacacacacacgcacaaaagctttctaaaaataactgcaaacgttggctttgtagtaaatacatgtctatttgagtcacaaacaatttcttaaagatatcttgcctttggagcaaaaataaataatagatctagtatacagtcatatcctagactgtaatgcacaattttacaaaaagcacatcaggagcatcatagtcaaaatcgtactaactaaacattttctgatgaataatgtgcaccttgaattacttgatgcaattctcaatacatgtatttttaccagcaaatgcgaattgaatgactatgagcaaaagtaactccttgagttataatcacacatataatacaattatgacctctcttcaatatatacagtatgtgccacaagatggaattttagaatatgaaaagaatttgtaaccacaccgagccataaacacagagtcaagagacatgagaggaaaactagagcatctattttaacctagttttaacttcatcacttgttctaaaagtgtaaaacattcctcccagcccatattttctcttctctgcatagatataattcctggaaaataaaccagcagacaaggcagattaatctctcattgtcacacgaacactgattttggtggcaattgtttttcctatcctcacattctcttcataggtaacaataattccagggtactatggtaggaaaaaataatggtacccccaagatgtatacgtcttaatctctggaacgtgtgcatattttgtattacacagcaagggagaattaaggttgcagatagacttacattgctaatcagctggctttatcccggattacccaggtgggccccatgtaattacaagtggagaagagggaaatggaagagtcagaatcaaaaagacggcacagtcaaaaagactcaactggccattgttggctctaaagatggaagagggtcatgaacctagaaacgtaagcagcctctagtagctggaaaaggcaagaaaacagattttcctagagccttcaggaaagaatgcagccctgcccacaccttgattttagcccagtgagaaccacagacctccaggactataggataacagatttgtgttattctaagccactacatttgtggtaacttgctacagcagcaatgggaaactaatacaggtgtgcttattgtaattaacacacccgaaatatgagacgttcagacctttccaaatacttgggaatttaaggtagcatgagaaagagagcatgaacaaaacattgactgcggacttgctacatactagaaactatgcaaaatgctttgtattgattacctaagttaatcttcataacaaccatgtgagacgggggcttttataacccctggatttttaaatgaagaactgaagagcagaaaagtaatttatcaaagatcacacagctagttcacattgcaggcaagatttggaaccaggctgcctgattccagagccaatgacattaaccactacattatacttcagtctcattgtttttatttacctttgattataataaagtggagacatttttacttgtataaatataaggggtccaagtgcagttttgttacagggatacattgcatagtggtgaattctgggcttttagtgtaatcatcacccaaataattacattgtaccttttaagtaacttttaatccctcaccgcccaaccccaaccctcccacctttcctagcctccaatgtctatcattccatcctctatgtccatgtgtacatattatttagctcccatttataagtgagaacatgtggtatttgactttctaagttctttcacttaagataatggcctccagctccatccaagttgccaaagacattatttcattctcttttacagctgtatagtatcccattgtgtatgtgcatatcacattttcttcatccaatcatctgttgatggacacttagattgattccatatctttgctattgtcaatagtgcaataaacatacaagtgcaagtatctttttgctacaattatttattttcatttggatagatacccagtcgtgggattcctggattaaatggtaattctttgagatatttccatgaagttttccaaagaggttatactaacttatattcccaccaatggtgtataagcattcctagaccttttatgtttcatgaccaatttcattttttctatgagtagcttgtttatattctttgcccagtttttgtattgagtttttcattatttttactgattttcatcattcttactgatttgaagaagccattttatatttatagatattaaccctttctaatgttgaaaatatttcccttatttcatctttcagccgaacttatggtgtactttgcctggccataatgtttactaaatcattctatctttctttaaatttattgtttctagccttggtaccattgaaagaaaggtcttcctgattacaagatgataacaatattctctagtatttcttcctatttctttttttgatgaaattttttaatttctctctattatgggtatatgatatgaggtatttcccaatggaataaactaattcaataccactttaaaataattaattgccatctaattaccccagtgaaatgcttcctttctcatatattatttttctgtacctgtatttcaaatctgtattttgactgttttgttacattcatctatcttctccaaagactaatattacattatttaatttctatagctttatagcatattttaatagctaaaaatagatctcttctgatatatatattcttaactgtttttatcatgggtttattcatctgtataatagatggtatagtcagaccaggcacagtagcatgtgcctatagtcccagttcctcagggggctgaggcaggaggatcacttgagcgtaggagtttcagtccagcctgggcaatacagcaatacctcatctttaaaataaaaaataataagtatagtcaaattgtcaaatttaaaaaaaagttttggctgtaattgcattaaacttatagaaaaagtaggaagaaatgagatctttgcaattctgtatttttccagctgaatctgatttccatctctacagctttggtaacagtcttaggcaaggtacttcacttcattagacctgagtttccccataggtaaaacccaaggataatcacagtaataacctcactgtattgtgagaagattaaagaaaaaatataagtattaaatatactacgcaatccacagaaggtacttattaaatgttatttaattggtctaacctttttatattttctttatagaactcttaaaaatattttaaaattattttctttaacatacttacatagtgaatactatgtgccagatatcattctaaatgttttctaaatattaactcaataaatcctcatagcaacgctatcaaatgagtactataattactacacttttcagattaaataactaaggtacagagtagtgaagtaccttggttcaggtcacatggcccctaccaggtgaagcagggattcaaaccacagcatgcctttaatcattatctattgccttgttattttaattcctaagtaatttagttctttattactattccacatgaagtcttatttttcatgtcttttaattactgctgctagttagaacactgtgtttttcaaattcattcactcattcaaaaaatagctattgagtatccactatatacaggcactgttctcattgttctagtcactgacaacacagcagttggagaaggctgtacagaaaaaagacaaaaattcctgccctcatggtctttacattctgatttagttagacaaacaatatacaaatgaatatataaatatatgaagcaagaagtggtatcaagaaaggcaagaggaacagagtgctgttttatgcagcatagtcgaggaagcctctgggataatagggcaactttggaagaacattttaggaagaaatgggcttaatgctgaggaacagccaggacagcagtgtggctggaatagggtaagcaaggaagagagcacagaaaagtgggtcagagatgtgtggctggatcatatagagccttgtggccattctgactttggccttgactgatatggaaagccatcggagagttttgaatggagaaatgacatgatctgacttgtattctgctgctctgctaagaatagtctgaaggggaaagggtagaagcaaggagatcagttaggaaattactatagtaatgcaggaaaagatgatgacggcttagagcaaaggggtagcatcatgtagagggaaaaaatgcttggattatgcatttaaaggtaaaggaaacagaatttgctgacaaattgtgacgtgcaaagaaaagaaacaggaaggactgcgagatttctgtcatgagcaactagaaaattggaattgccatttattaatttggataagtttgcagaagaggttctctattatttttaggtataataatcatgtatctcttcctttataatattcattccattttttctccttacacaaactgcattggctagaaccactaaaataataagaagataatctttgtcttgttgatgaatttaacggcatgcctggtagggcaccaccatttagtatgatgcttgctactggattctcatggataccttttcagcatattaaggaaacttttattccctcagtaaagaacaaaaaggtggaatagcataatggataaaagcacggactcaggattcaaactgtctggactaaaatgctgatcccctccctaactgcaccaccttgggaaaattacctaactactccgtgcctcagttctctcatctataaaatgaatataccagtaatagctagctcatagggttactgtaaagattaaattagatgtaaagtgctagcacaatgcctgacacataataatcatcctttctgtaggaaaagtttttatctagaatggctcttgtggtttgttaaatttatttaggatatctttcacgatggtcatacagcttttcccttttaatacattaacatatttaatgtcggatgagaagcatctctacactactggaagtaaatttatctacttatggtgtatttttttaatataatcctgaatttgatttgctctttgtaacaggattttgcattcacattcacatgtaaattgtctctggttttcttgtcttttttatttcagttttggaagcaggttacataaactgaagagtttggggccttttttctagtttccagaataattcaaccaacatagaaattgattatgttaattgaatatttgaaagagcaaatgtaaaatcatctaggattggcacttttgtggagtaaacccttaataaaattccagtgtcttctatggttactgacttactaatatagtcgactttttcttacattaattctgtcatttacatttctctaggaaataagttctttccatttaggctttctaatttattgactagaaatcatacatatttttaaatcggttgttattgtccatatttacagttctatcaccattgtaattcccagtgttctgtattatttttctctccttggttagtctaggtggggctagtttatcagcatattcagagatttagttagctttatttttatcaaatgtctattggatatgttatttattcattgtttatttactttttaattaactactctctgttcttaactataagaattcagttacctatttcacatttgagttgaatgcttcactcatttaattttattctttcttattcaaaggtaaaagcattataggctgtgacatttctacggaggttttgcccacatgacttaggttttgacgagttatttttcatttcaattattatatacacagcctgtaattcagtttttgtgtcctttttactctgaaaattatagttgttttttaaatttatcaatgcttagaatcattatatgtcttgctctatttctagtgttaccacattatagtcagaaaagaattcttcaacttctaataatttatttagaatttttttgaaaactagtatgtagtttttgttatgttacatgtgacaaaagttctttgattaaccaaattttagctggcctcctaaaacttctcctaggcccatctgtgtacttccttgtaaaatagcaagagctctgctcagtcagtttagcaagaacctccacccttgagatcttatcagattcctcatcctccaccatccctcaggtgatacctggtcaccatggcctgtcttcagctagacttttcgaagttggtttagccaaaaaccctcttacccatgtttcctcttggtaattttccatccactgacccctgccctgttccccggctatgaatttccacttgcccatgctatatttggcactgaccccaatctctctcccccactgcaaaatcccattgcagtggtccctatacctgtgatagtcctgaatattgtcttccttaccttgctttaacaagcatcattgaataatttttgttaatgcatgagcattgaaaagtatattctattttttagggagagatgtgtacttttcaagcttattaattgcataattcaaaccatcaataactatttagttcgtctacttcattcgcaaatttttggaaatgttaccatacacagtatatcactgtgattgaattattaccaaattttctttgtatttctaagtttgcttcatgtgttttgttgctgtagtttcttcagtttgtttgtttgtattaaggcttttttccaacttttaggttcaagggtagatatgcataacgtgcaggcttgttacacagggaaatgtgttcctacatcatttctgtcatttatgtttttctaggagataagttatttccatttaggttttctaatttgttgactagaaatcacacatatttttaaatctgttgttatcttctatatttacagctctattaccattgtaattcctaatgttctgtattatttttctctccttggttagcctaggtggggctagctgcacagatcatcccatcacctggctattaagcccagcatccattagctattcttcttgatgctctccctcctctcacccccaaccctccaacaggccctgtatgtgctgtccactccgtgtgtccatgggttctcatcatttgcctcccacttataagtgagaacatgtggtatttgattttctattcctgcattagtttgctgaggataatggcttccagatccatccatgtccctgcaaaggacatgatttttttcctttttatggctgcatagtattccacagtgtatatgtaccatattttctttatctagtctatcattgatgggcatttaggttgattccatgtctttgttttgtgaatgatgctgcaatgaacatacatgtgcatgtatctttataacagaataatatatattcctttaggtatatacccagtaataggattgctgggttgaatggtatttctgtctctaggtctttgagaaatcgccacactgtcttccacaatgttgaactaatttacacccccaccagcagtgtaaaagcattcctttttctccacaacctcgcatctgttgttttttaactttttaataacagtcattcttactggtgtgagatggtatctcatgtcgtttagatttgcatttctctaatgataggtgatgttgagctttttaaaagtttcttggccacatgtatgtcttattttgaaaagtgtctgttcatgtcctttgcccacttcttaatggggttgtttttttcttgtaaatttgttttaagttccttttagatgctggatattaggtgtttgtcagagagtagattgcaagaattttctcccattttgaaggttgtctgttcactctgatgatagtttcttttgctgtgcagaagctgtttaactcgatcctatttgtcaatttttgcttttgtggctattgcttttggaattttcatcatgaagtctttgtccatgcctatgtcctgaatgatattgcctaggttttcttccagggtttttctagttttaggctctacatttaagtctttaatatatcttgagttgatttttgtataaagtataaggaaggggtccagtttcaattttctgcatatagctagccagttctcccagcaccatttattaaatagggaatccttcccccattgcttttgtcaagtctgtcaaagaccagatggttgtaggtgtatgatgttatttctgggttctctattctgttccattggcctgtgtgtctgttttggtaccagtaccatgctgttttggttactatagtcttatagtacagtttgatgtcaggtagcatgatgcctccagctttgttctttttgcttaggattctctttgctatttgggctcttttttggttccttgtgaattttaaaatagttttttctaattctatgaagaatgtcaatggtagtttaataggaatggcattgaatctataaactgctttgggcagtatggccattttcatattaattcttcctttccatgagcatgaaatgtttttccatttgtttgtgtcatctctggtttctttgagcaggggtttgtagttctttttaaagaggtccttcacttcccttgttagctgtattcctaggtattttattctttttgtggcaattgtgaatgtgagttcattcataatttggctctcggcttgcctcttattgctgtataggaatgctaactatttttgcacaatgattttgcatcctgagactgctgaagttacttatcagcttaagaagcttttgggctgagatgtggggttttctacatataggatcacgttatctgcaaacaaagatagattgacttcctctcttcctatttgaatacctttatttctttcttttgccggattgccctggccagaacttccaatacttgaataggagtggtgagagagagcatctttgtcttgtgctggtttccaaggggaattcttccagcttttgctcactcagtataatattggctgtgggtttgtcttatatggctcttattattttgaggtatgttctttcaatacctagtttactgagagtttgtaatatgaagggatgctgaattttagcaaaggccttttctacatctattgagataatcatgtggtttctttacttctgattatgtaatgacttagtttattgatgtgtttatgttgaaccagccttgcatcccagggatgaagctgagttgatcgtggtagataagctttttgatgtgctgctggattcagttttctggtaatttgttgagaatttttgcagtgatgctcatcaaggatattggcctgaagttttctttttttgttgtatctctgccaggttttggtatcacaatgttgctggcctcatagaacgaggtagggaggagtacttccttttcgatttttttggaatagtttcaataggaataacaccaactcttctttgtatctctggtagaattcagatgtgaaactgtgtggtcctgggttttggttggtggctatttattactgcctcaatttcagaacaatattggtctctttaagtttttcagttaagcaaaagaatggcacatcatctttatgaattaaatgttttattattattttaaaaaattgactttgttccatatattgctctttaccttgaattatgccttgttattaatattactacatctgctctccttttgtttaacttaactagtagagttttgcctatccatttattttccttctatttctgtcattttatcttggctttatctcttgaaaatggcctatagctacagtttgcttttttgttttataatctgagcagctttgccttttaattcactaacatttgttattattcctgctgctaaattgtatgtaatgtttttattctcctttcctattcttttccctcctcttctctcttctctgttttcttgatcaagcgttcttcatttctttattcctttctagctatttttccttaacattttattcctaatagtcctttactttttgcaaatatattaaacctacatttcttactgacatcaataattacattgtaactatgtccatctttaacaaaacataacttgcatcttttcccacttttaacccaaggatttttgataaaacaaggtagaattttaatgctatagtgttactatttcctcttttatttcagaaatactttaataattatgttgtatttgacaaccatgttttcaatagcgacttaggtttactaatttcattgctcaccatagtttcttgaatatttaaaaagattatatgagatactgtgatattttgctgccttcaggttaccaaaaggcacagaatttacaaacatagtgccatgaccactaaagtcctatatactggaatatgattcatccaccccagagttgcaagcagtctttaggagatataaagatatgagaaatcttttgagagatatgaaaaaaggattagaactatgatgtggtcacattttgcggaatgcagtctttgtgtagacaggttatctgttctcctcccctcccataggtgtagaagaaaaaaacactcaactgggtttccttcccaaagttcacagaaagaagaaccaagaaaaacttgaagtgtgttgctgggcctcagaaagcaacaccctaaattatgatgttttggcacgctaagtactttgaactgaaggacagtggcagggcctcagaagcaaggtctctctcttttttctttcttttttttttttctttgagacagggtctcatcatgtcacccagtacacagtgcaatggcaatcatggctcactgcattctcaaactcctaggttcaaatgatcctcccacctcatcctcctgagtagctgggacaacaggtgcatgccaccatacttggttggaaatccttctgtccttctgagcttctttctcctgctcccctttcttccccaaggcaggccataaaaaatagaattcctcttccccaaggcaagtcatataaactagaaatattactctaaccttctccgacctttctgtgtacaacctggccatcaagaaattctctaacctactgtctgatagtaggtcataagaccctcattctagaaggagtcctgccctacacccagaaggaacaaatgcctcacagagaggtcaagaagaacctcaactgacaggccttgctgggtttccccactcagtctattaccattaagtcattccctttttgtctaatcacattcctatgtggccgtccattctcatcaaacctaaaaataaaaatgaacagttttcccttgggtctttacttctgaatgctcctgtgacatataaaactttgattaaataaatctgttattcttttttcttgttaacctatctttagttgtaggagtgttgaccctgacccttaagatgggttaggaaaggtatcacacccttctgcccctacagttgctgcatgaaggaataaccgacaaattcagtccatggttgaactttccctttgcttgacctaccccaaagcttaaggcagagtgggagtagaggaagagggacagggaaacattagactgaaatgacaaattgttcctggtgaaaaagaacagtttctagaatgtatggaacatgggtcctgcccagacccagggaagcctgaattggggcagcaaatggtgaatgagactgagagccacagtctggccatcaatcagtgcagcaggaggtaaacaagcaggagaggaagagagcctgaggctgactgcatggtgtgatagcatctatttgtgggaggctattgacaaacctgctttggagtaatgctgaagagaaaagggtcaaaaatactgtgggcagtcacagtgtatgaggcatcagttttcagtttcctccttgtccctcctccctgcaaagtggaagaatgggggccagggacagagggaacaggaaggggaggaaatagagagaaagaacagaccatgtattccctaccattctctaccataccaagttgcttttgcaaagagaaaaagcattaaatgaaatatgagatgaagttttcaagtggacaggaccaacaaagctggaagacttaaagtaccatatatcacgataatgtaaaagaacaactggcacagggatacataaatagatctatggaactgaatagaacccagaaacagaccctaatctatatagtcccttgatttatgacaaggatgacatggaagtgaggcacttcttattaaatgacgctgagtcaatttcatatctatatacaagaaatgaatctcaacccataccctgagccatatataaaaataaattctagacagattacaagcctaaatattaaagggcaaaacaataaaatttctagaagaaaaaaatttaaaggcacacagcccaataaaaaatgagcaacgtcaatggtggattgcatttaaaaaaaaaatgtggtacaatacaccatggaatactacacagccataaaaagaacaaaatcatgtcctttgcaacaatttggatgcagctggaagccactatcataagcaaactaacacagaaacagaaaaccaaataacacatgttctcacttgtaagtggagctaaacactgggtatacatgcacataaagatgggaataatagatactgggaaataaagagggggaaaggatgaagtgagacaagggttgacaaactacctattaggtgctatgctcactacctggatgatggattcattcatatcccaaacctcagaatcatgcaatatatctgcatatgtattccctgaatctaaaataacagttgaaaaaaacaaataagcaaatatttggacagatatttcaaaaagaatattcaaataccaaatatatatatgtgtgtgtgtatacatatatgtatatacacatatacacatagttgttcaacttccttagttgtcaggaaaaatgcaaattactatcacagtgagacaccactacatatccaccagaatgactgaaatcaaagacagatgaaaccaaatgttgctggggatatgaattctcataccctgctagtaaaatataaattggtgcaaacactggaaagttacttagtagtacttattaaaccttcaaatttgcatactctgtgaccagcaattcagaaattcttacctatgttcactaaaaaacatgtacaagcatgtacagcactgttcataatagtgcaaaactgtccatcaatagtagaaagaataaactgtagtacattcacaaagaatactacacagcaatgaaaagcaacaaaactattattactctccacacaaaaatgtgtcttacaaacataaaattgaacaaaagaagtcatatagaaaataacacatactgaatgattccatctgaacaagttgaaaaacgaaaacaggacagtaattacccttctgggggatagtaactagaacagggcacaactggggtttctgagatgctagcaatattctatttcttaatttggattctggatacatagatgtaatgacttcgtgaaaatacattgtgctgtaaacttatgatttacatacctctctgtgggtttatttaaacaaaatgacaaaaactaagtcttaatagctggaatgtgactgttttaataacagaaagtgaaaaattatagaattggatttagatgtcattagggagcatgttattcagcaggaatggagatttcattagataacagtggtaacagaaattggaaaaatacaattgttttatgtttattccttatgatctaagaattttcagtcatttcagttatattaatctttccttttcttgaaattgatgtgattcaaaacatgttatcccaaaatatggtatcttcgcatttgagaaaacagcagaagcaagaaagtctctctctctctctctctctctctctctctctctctcacctactctcccctttcttccctgaagcaggccacaaagcctagctgaccttatttattatttagttattagttatttatttttataaactcttttctcttaaatttaatctcttagtaacttgaaacttccatcctcttgctatagccttcattttatacatacagcttcaaagtaacccaaattctctatcttctaaaccaatttccaatgcacaaaacacatcaataattctaggtttctacaaatatatgatagctatttttgtcttccatttttatccctacaaactagttagatgcattttataatcccaagcagaaataccccaattatgttaagtgactcaagggatagagttaattttgtatgaaaagattaaatttgcttgattgctcttttttagtgaagactatgttaatgtcaagtttaagagtgatagtattttgcttttgacaaagacataagggaaaattcttctcagctagttcagtatactctaaatcagccacaaatataaatcctaactcaagtttctcacaactagaagaaatcagaagaatatgataaaaatcaaagaattcatatcatgaaaatgaaaggtacaagagaaattcaataacatgctcttcctattttttgtttgacttaccataaaaatctgcactaatgggggacatctatgttttcaattctaagcataagttttagatctccataacatgaaaatgaccacagattctgaatgagtagctgctctccaccaccatatttccaagctctagaaactcagtgctagagctaaactgagttgttgctattgttttatttagaccacttgaaaccctgaaaatcatcaaaatgcagaaaatcactatgttggttaggtttcctgtggcaggaatatttaaaacaatttaagaaaactcctaaccagaacatgttcagagaattattaacatttttattcagaagtttagatgccattttctgcctcatactccctcattccctccagttcaactcttcctaattaagttttctggccttgccctacccccacctgatcatcatgataaaactaggacataagtattaatacttattaaagcattacaagtattaatatgtctactgttccatttcatggatctactcctactaatgaaggaggagatactaaaaatctaaataagaaattgcttttaaccttgaaaatttagaacattacattatgatatccttgaggttatttgaggaaaaatattatttagtaaactggaaggagtgaaattttttttctaaaggtgtcacaaagaagcaagtaatattggtaataacaattttaataatgtactatctcttataatgaaagatgatgttggtaacccagacaagctaatgggcatatgtttcacactggggtaatacttcactaccagtcacaggaacaaaaagccttttgcaaaactatgtgacaaaattaactatgcagtatgtatcaaagaatactgtggtggttttcaaactatgctattcagaacccttcagagatttagggtaaagcagagtcacattttgaggtgttctgcttcattcggattgatatcttcattcatttatgcatacaataaatacttattaagctatctattacatgcatgcctgtggttgactagcactttctggtatcacacctgtaatatgatagaaacagtccctgctctcagaaagctcagtctagctaaaaataaacacatcaagcaaataatggtagaagtaattaattaatggtcaaaggtacaaacacaatagaaacatgtatagagtgctataaaagaagtctttggtaagtttccttcaccttacgggttttctcataagattttagctgaataaagggtacatgcttccaagtgaccaaaataatgtaagctaacctgacacttatggtattaattaccaaatctaagctctgatgccctattttattgtgtcactttgattcaaaagaaccatacattcaaacgttaaggtatcttaagaatctctgtataccagatactatgttagaagctttagggctataaatatgcattcacttaagaaaatatttcaaaatattggattgaatatttactatgctaggcactggggattaacatttccatgtaataattagtttccagcatttctcagaaaatgtatgtttttccaaatcccaagaaaaatcagtcaagaaatagagaaaaacaggagaaaaaatggcggataggaggtaggactaacttgcagctcccactcggatgtacagagcagcatgtggagactcacactgtgaacttttgctccaagaactaccataggaacatatcaggaaagccaagagaatgcacagaccctttgaagaaggtggattggcaccgcaggctgtgtgggacagcagaggaactgtaagtctactcgctttctcagctgggaggcttgtagcctgaggcaagttctccactctgctcaacggctgcctgaaaataaactcggttctattgggagggcacagtgtgagtgagactggcctttcaggctgtgagttgcgggggagctgggtgaggcctgtggctgccagctttcctccacttccctggcaacctgtgtgagcagcagaggcagccataatccccctgggaacataactccattggcctgggaaccaaactcctttcccccatagcagccacagcaagccacgcacaaggagtctgagctcatacacgcctatatctgccccaacctggtggtgtttctctacccacactggtagctaaaaaaaaggacaatctcttaggagcgctatggccccacccactcccagaccctagggcaagcttgtatcctacctatactactggagctgatgcgctcttgaaagtgccacctcctggtttttggagggcaaccaacacaaaaccagggcacttaaaaatacaaccaaggacccccatagagtccgctttgctcccctgctacacccacaagagcaggtgctggtattcacagctgagagacttgaaaacagatcacatcacaggactcttcgtagacactccccagtaccagcccagagcctggtagctctgctaggagactagattcagaagagaaataaccctcactgcagtttggctctcaggaatccccatcactaggggaagggggagagcaccacatcaagggagcaccctgtggtacaaaaaaatctgaacagcagccccttagtgtcccagatcctccctctgacgtagcttacccagaaaaacaatcctggtaatatggcaaaacaaagttctttaacacccccaaaagttcacactagctcaccagcaatggatccaaaccaagaagaaatctctgaattgtcagaaaaagaattcagaaggtcaattattaaggtaattaaggaggcaccagagaaaggtgatgtccaactaaaagaaataaaaaaaagatacaggatatgaatggaaaaatctccaatgaaataaatagcataaataaaaaacagtcaaaaacttctgaaaatgaaggacacgcttagagaaatgcaaaatgcaccggaaagaatcagcaacagaattgaacaagtagaaaaaaaaaacttcagagctcaaagacaagttttttgtttgtttgttttgttttgttttgttttgagacggagtctcgctctgtcgcccaggatggtgtgcagtggtgcgatctcggctcatgtgcaagctccgcctcctgggttcacgccattctcctgcctcagcctcccgagtagctgggactacaggtgcccaccaccgcgcccagctaatttttttgtatctttagtagagacggggtttcactgtgttagccaggatggcctcgatctcctgacctcatgatccacccatctcggcctcccaaagtgctgggattacaggtgggagccaccactcccggccaagacaaggtttttgaattaacccaatccaacaaagacagagagaaaagaatttttaaaaaggaacaaagcctccaataattttgggattatgttaaccaaacctacgaataattggtgttcccaaggaagaagagaaatctaaaagtttggaaaacatattagatagaaaaattgagaaaaatttccccagcctttctagagatctagacatctaaatacaggaagctcaaagaacacctgggaaattcatcgcaaaaagatcatcacgtaggtacacagtcctcagtttatctaaagtcaagacaaagaaaagaatcttaagagctgtgaggcaaaagcatcaggtaatctataaaggaaaacctatcagattaacatagatttctcagcagaaaccctataagctagaagagactggggttctatctttagcctccttaatcaaaacaattaacagccaagaattttgcatccagcaaaagtaagcttcataaatgaaggaaagatacagtctctttcagaaaaacaaacactgagagaattcaccactaccaagccagcactaaaagaagtgctaaaaggagctctaaatcttgaaacaaatcctctaaatacaccaaaatagaatctccttaaagcataaatctcacagaacctataaaacaataatacaattgaaaaaaaaacccaggtattcaggcaacaaatagcatgatgaataaaatagtacctcacatctcgatactaacattgaatgtaagtggcctaaatgttccacttaaaagatacagaattgcagaatggataagaattcaacaataaagtatctgctgtcttcaagagactcacctgacacataaggactcacataaacttaaggtgaaggggtagaaaaagatattccatgccaatggacaccaaaagtgaacaggagtaactaatatatattcttatattcaatatatattcttatattgcaacagcagtttaaaaacacaaaaagggacattatatattgataaaagaactagtccaacaggaaaacatcacaatcctaaatatatatgcacctaacactggagatcccaaatttatgaaaccattactactagacctaagaaatgagatagacagcaagtcaataacagtgggaaacttcaacactccactgacagcactagacaaaccattaagacaaaaagtcaacaaataaacaatggccttaaactataccctaaaacaaacggacttaacagatatttacagaacattctatgcaacaactgcaaaatatacattctattcatcagcacatggaacattctccaagataggccatatgatagaccacaaaacaagtctcaacaaatttaagaaaactgaaattatagcaagtactctctcaaaccacagtgaaataaaatggaaaatcaactccaaaaggaaccctcaaaaccatggaaatacatggaaattaaataacctgctcctgaatgatcattgtgtcaacaatgaaatcaagatggaaatttaacagttctttgaactgaatgataacagtgacacaacctatcaaaacctctgggatacagcaaaggcagtgctaagaggaaagttcatagcattaaatacctacatcaaaaagtctaaaggagcacaaatagacaatctaaggtcataccttaaggagctagagaaacaagaagcaaccaaaccaaacccagcagaagaaaggaaataaccaaggtcagagcagaactaaatgaaatggaaacaaaacaaaataaaaaatacaaaagataaatgagacaaaaagctggttctttgaaaagataaataaaattaatagaccattagcaagattaatcaagaagagagaagatccaaataagctaagttagaaatgaaatgggagatattacaactgataccacagaaatacaaaagatcatccaaggctactatgaacacctttatgcacataacatagaaaacctagtggacatggataaattcctggaaatatacagccctcctacattaaaccaagaagtagaaactctgaagagaccaataacaagcagtgagattgaaatgctaatttaaaagttaccaaaaaaaaagtccaggaccaatcagacatttaaagaattggtaccaatactactgacattattccaaaagagagaaaaagagggaatcctccataaatcattctatgaagccactatcaccctaacaccaaaaccagaaaaggaagtaacaaaaaaagaaaactacagaccaataaccctgatgaacacggacacaaaaatctgtaacaaaatactagcaaaccaaatccaaaagcatatcaaaaagataatccaccacaatcaagtgggtttcatacgagggatgcggggacggtttaacatatacaagtaaagaaatgtgacacaacacataaacagaattaaaaacaaaaatcacatgatcatctcaatagacacagaaaaagcatttgacaaattccaacatcactttatgactgaaaccctcaacaaaattggcgtaaaagggacataccttaaagtaatgaaagccatctattacaaacccacagccaacattatactgaacaggaaaatgttgaaagcattactgctaagaactggaacatgacaaggatgcccactctcaacacttctattcaacatagtattggaagtcctagccagagcaatcaaacaagagaaagaaataaaggggatccaaattggtaaagaggaagtcaaactgtcactgtttgctgaagacatgattgtatacctagaaaaccttaagactaatctagaaagctcctagaactggtaaatgaattcagcaaagtttctggatacaaaattaatgtacacaaatcagtagccctgctatacatcaacagtttccaagctgagaatcaaatcaagaactcaagcccttttacaatagctgcaaaaaaaataaaataaaatatttaggaatatatctaaccaaggaggtgaaagacttctacaaggaaaactacaaaacactgctgaaagaaatcatagacaacacaaacaaatggaaacatatcccatggtcatggatgggtagaatcaatattgtgaaaatgaccatacggccaatagcaatctacaaattcagtacaattcccatcaaaataccaccatcattcttcacagaactaaaagaaaatcctaaaattaacgtggaaccaaaaaagagcccacataaccaaagcaggactaagcaaaaagaacatacctggaggcatcacattacccaacctcaaactatactaaaaggcaatagtcaccaaaacaacatagtactggtataaaaataggtatataagccaatggaacagaatagagaacccagaaatacacccaaatacttacagccaactgatcttcaacaaatcaaaccaaaacataaataggagaaaagacaccttattcaacaaatggtgccgggataattgactagccacatgtaggagaatgaaactggatccttgtctctcaccttacacaaaaataagctcaagatggatcaaagacttatatctaacatctgaaaccataaaaattctagaagacacattggaaaaacccttctagacatcagcttaggcaaagctttcatgaccaagaacccaaaagcaaacacaacaaaacaaagacaaatagatgggacttaattaaaccaaaaagcttctgcacagcaaaaaagataatcatcagagaaaagtgacaacccacagagtgggagacaatcttcacaatctatacatccaacaaaggaccaatatccaaaatttacaaggaactcaagcaaatcagcaagaaaaaaacaaataatcccatcaaaaagtgggctaaggacataaacagacaattctcaaaagaagatatacaaatggccaacaaacatacaaaaaaatgctcaacatcactaatgaccagagaaatgcaaatcaataccaccttactcctgcaagaatggccataatcaaaaaatcaaaaaaataatagatggtggtgtggatgtggtaaaaatggaacacttttacactgttggtgggaatgtaaactagtacaagcactatggaaaacagtatggagattccttgaagaactaaaagtagctccaccatttgatccaggagtccaactcctgggtatctacccagagaaaaagaagtcattatacgaaaaagatacttgcacactgatgtttatagcagcacaatttgcagttgcaaaaatatagaattagctcaaatgcccatcagtcaacaagtggataaagaaaatgtggtaaatatatataccacggaatactactcagcaataaaagggaacaaaataatggcattcacagcaacctgaatggagttggagaccattattttaagtgaagtaactcaggaatgaaaaaccagacactatatgttctcattcataagtgggagctaagctatgaggaaacaaaggcctaagaatgatacaatggactttgggaactcggggaaagagggggcgggtgagggatataagactacacactgggtacagcgtacactcctccagtggtgggtgcgccaaaatctcagaaatctccactgaagaacttattcatgcacataaataaataaataataaaagaaatagggaaaaccagaaccagtaaaagtactataattctcttgtgaggattgaagcttaataacatggagacattactggttcaaaggaatatactgatgtaaagttgaaagcaagagcagataatattgacacatggagtagaacactgaagttccagtaaccaaggaaggtgaacataggagagaagttgtcacatttaatcagttagtcttattgtggctgttgcagagttatatgtgagtattcatggcattgcatgctgctaacagtgaagaactcttgcaagtaaaataaacattaacaagtttacacgcataatatactttatgcaaatccactgagtggtgttccaagaaatgacaagttttggaagcaaagtaagcccttacattgacaagtttgacatataattctttgaggtactgttagctttgctaggagatctgaatgttatgtaattcaaatactacccaatcacttttgactggtgttttctagtgtctgaatattcactacaggctacagttctctataactattattaaacttcatatttctcatatattaaacaaaatgttagatatttaaaataatgagcaaagcatataaaaactgttgaaagttttttgttttgtttttgtttttttttttgagacagagtcttgctctgtcacccaggctggagtgcagtggcacaatctcggctcactgcaacctctgcctcccaggttcaagcgattctcctgcctcagcctcctgagtagctgggattagaggtacctgccaccacgcctggctaatttttatatgttttagtagatacagggtttcatcatgttggccaggctggtcttgaactcctgacctcagatgaactgcctaccttggcctcccaaagtgctgggattacaggcatgggccaccgcgcccggccgaaagtatttttaaaacaacttacaatttcaggaattcccagaaattctcaagaattactacttctcatttctgaatcccaaagattaatatttattgggaattgggaaatactacttgagataaaagttgactaagagaacttccctgcctctttgaagtttaggagagagatgaaaacatggaaaccaaaaaaagtattaaaggtgttaagataaaattctatttaggacacagtgaagacacaaaggcaaaagacacagagcaattatgcccacagaggtctggagaaggctttacagcaaagaacatgagatcttgagtggtgtcctaaaaggcaaaaactaccttctagataaaataaagggagatatgagactgctaacaggccatacagagggaagactgctgaggctggggtcatgaaacatcatgggttgttcagcaaacatttagtagtttagggaggaaggtggagtttgatgggagacaggaagaacagaaagggatttaattcagggaagatcttctaatgaaaggaaaagtctcccaagaatcttaagtagttgactgacatgatcagatttatattttttagaaagatccctctggaggacacatggaggatgggttcaaagtgtgtgagactagagattagtactgcaacagttaggtgcatccctaaacaatacaactccatacattgttaaagacccacacatacccaacacactgcagggtagaaacctgtaagaggaattgggaatgaaagtgaatactaagtctaatgggtaaaataacaagattttaaaacagagagtaaggcagtcatgatgcttgttgattgtatcatgaactgaagagtataataaactcaagccactgtagctgaggtacctaggaacaaacaaatgaaaggatggctatatctttcctactgataaattaaactacatttgccccaaggctgcctccatactttgagtcctatgtaaagaactacaacccaaattagtacataaactcaggaaaagctaattagaagtatacttttgtaacaaatatctgagtctcagccaatcacagcagctgagctttagtctatcacaagcagccaactgatcagaccatgttcaaataaggcaaatgcctagctaaaataaatcaggctgttcctgtacctcgcttctgtgttctgtccataaatgcagcttgcccaggtctcagagcagaaccctctgaacctcttctggttctgagggctgcacaattataatgcaaatcattctttgctcaaattaactgttaaatgtaatttgtctaaagtttttcttttaacactattcttttcatataatcacatgaaataagagaagaaaatcaatggtagaaaaattcccttgtacagtaaatcaaattgttaagaagtgtaatttctttaaaaagatatatctagttactctatcactgactctcaaataatctgtagaactttattcattttctaaagagtcttgttaccctcatgatccgtatcaacctgcaattcaaaatatcatagaattgatagaattgttttgtctatcagtaattgtcttcatggttatatttttttcagattatatttgggaaaagctacttattagaggaatatctacgaataataatcagtctttcacaagcccaaaagctctgatatctccctccctcatgatcccattgctgttgatagtgttatgcagattttgtaaacaattaaatctgttcgcatgcaaacaattttggtttaaccatgaacaacaataaagaagttcatatacttcttttatgtaattcacgatctacccatgctccttttaaaagcatactaatatatcctattatgtattccaaagctgttatacgaaagtgaatgttcttttcaaaattctttttgacatgccactggagcagctccagaaaaaaattaacacttttggggaattttattgcatccctttcagtagccaaaaaggaagcgggtggggcgggggtggggggctgaagccaaagattaaaataaatgcataattcatttttaacatggtaggttttctctcattcttcattgtaatagctctagaactaattttactgttaacactgaatttttagaggggtgttgtataaaccattttttacaaagaaggagactaaaaagattttctgctcaccatcagtgcacaaaattgaacaagtgaaaatcttcacacacaatatgcttccaatgagcatgctcttatgcatcaaagaggaaacaaagcatttcaggattatgtttgtaaaaggattgtttttgaaaaaaataaaaaagcatagagcaaatttcagagtggaaaaacatcaaaggcttttcaatagtcaaactcatcactagatttaaggcaacatttaaagcaagacatctgtgttatttatataatatcaaaaagaaaaagcacaaaggtagactcaagacaaataaagaatccacctcctatgctataaaatacttcttatgtttgtctctctaacagtatgctattattctagcaaggcaaatatgttcttaaaagggtatcatgttttgtatgatgctgatgagcgcagctttttcatgtgtcttgcttaatgcagctaaatactacgaatgctattcagttatcaaagatacaaagaaccattcaagtttaggaaattactagactctttcttacagaaacacaaattattataatgtattgttttcatcttcctgcccaatatccaaactttataatccattctatttttctctcacattgtaccatgagacacttttactgcgagcagtaagtatgagaatgcaaaatctagggaggggtgaaaagaagtaaaagaacaacaatgtaaaggaggggaagctgacatggagaaggaaaaataggattcaacactcttggattcagttattaattcttaacaaatgtccccagggagctcacccagtatttctagaccagatggaaaaaacagtatgctacagcaactctatccctagacccagctgtcatgaggaatagagaggcaatcccagtaaggaactaacatctaacaccatacttcatgtgtgctgcgccattcatatacaggctgaccttaagatggtgactgttttgtttgttggttggtttttgttttgttttgctggcttcttatgtatgtgcctctgttttttatatcaatccttgacctctctccaaagtccaatcatgcatttccaggccctgccaatgatctcctttgtacctttaagtcaacattccccaaaaccattcattttctcctaaacctgaaaaaaagaaaaaaactccaccacttgactttttccctgtggctggcaacaccattctctcaatccttcaagcattacattttaaaatgataactgagttttccttctctctcttcatcatatcaagatcttgctggccaggcacagtggcccacacccgtaatcccagcactttgggaggccaaggcaggtggatcacgaagtcaggagattgagaccatcctggctaacacggtgaaatcccatttctactaagaatacaaaaaattagccgggcgtggtggcacacacctgtagtcccagctactcaagaggctgaggcaagagaattgcttgaacccaggagacagaggttgcagtgagccaagattgcaccactgcactccagcctgggtgacagagcaagacaccgtctcaaaaaaataaaaaaaaaaattcttgccaaattatatagcctaatagcaaaatatttgtcaaaagtcgatccccttggccaagcgtggtggctcacgcctgtaatcccagcactttgggatgccgaggctggaggatcacaaggtcaggagatagaaactatcctggccaacatagtgaaactccttctctactaaaatacagaaattagctgggcgtggtggcacatgcctatcatcccagctattcaggaggctgaggcaggagaatcacttgaaccagggagtcagaggttgagttggaggttgcagtgagccgagatcacgccagagcactccagcctggcaacagagcgagactacatctcaaaaaaaaaaaaaaaaaaaaaagtagaacccctcttttccaattttgttatgtaattccatcccaaagtttggattacccaggcctctcacttaaatggtcacaaacacctaactggtctccccaccttcaatctctttatccccaattcattatatccactgctattaaattaatattcctatggcacaactgtgatcctcctcctccaattctcaaaaatctttagtgaattcacaattattgaaaatatttaaaatcttttagccatgaaaatcaaaggttttcatgatctcacctcaatctcacttttcaaaatgatctcacacaatctccttcatatactccatgtttgaaccactggactacatattattaagtgaaatgtacctgagcttgcacatcttgtgtctttattcacactaatcttccctccttgtttgctgtgatagggactgtgctagatagtatgatacaaagatgaataatagatcttatataggttctaagcttcttagagaagcatgagctttggaattagataggactggggtctgaattcagattctgcaattgccagctgtctgatttggggcaagctcttaacctgagagacagctttttgagctgtgaaatgatataataacatctaccttggaaagttgccaggatataaattacatattttaaaagcatgatatggtgtcttccatttaggtaagtcttccttctgaaataccaacattagcttccccaagcagaatgcactgatgacaataatgagttagctgtcacctgcaaagatcctgagttagtacagacagagaacaattgcagctttcctctactccttttcttccttgcagagacaaatgagggtgacctcacagtttatgcctcgtaacgtttgcctagtgatcttttccattctccaacaccatccaggcaataagcatcaatgttaatgagctgctggacagctttgtgaaactgactgaaagagccagataggtattggtgtcctacacatgcaaataatatactttcccttcaaatgtactatttttatataagtttcaaaagttacatcctggtggaatgacagtacccaactgaaatatgttttccactctatgttactgcttacttcaacgggaaaagaatatatttacactttgccatattatgtaaacatggaaaactgagctaactagtgtcatgttattaattgactccagtgatattttagcatcctttatagattggccccctggactcgtaactgcccgtaatccaagtatgtatatgtgaaataacctcaggggtcggtgggagggggaaaggggttatttacacagtgtttgaagaagtgcaacacttgcagtttcaattccagaagtagtaggtaccgaggcatcctggatagactgtaaaagagtagtcaagaaatcctggcagttatcaatgactagaagccaagtaaaagctgcaagtcataattgctggaaatttgtttacatgcaacagtattttcaagggaaagtaagaagcagagggaaaagggcttgatatagagcagacatccgaacccaagtacttaatagtaggaggaaaaagaaggctgaaactagcttagaagccatctaaaaaagaaatatttagttggtctttatttacactaaattagaaaaaattttacttaaacctatgcctcagtctaaatttcccagtgaacatttgtggagatttggctatctagaatccatttcttccttctttgggcaacagcatccttatttcattttagagaattccctcctctctattgtatccagtcttggtggtgctacaagtcaacatgccctgtgctcctctaaccagtaatcatccaagctatgccagtaagactctccaaaatttaaatctaaagtggagtagcttaagaatggaaaaggataaagtcccagaaatagcgctccaacaaaactattgtgagtatcttgctgttcagaaaccgtaagcctggtcactagcttttaccttaattctgctgactacccaataatctttcaataaattcctttctgcttccttaactagacttggttcctattgttggcagcctaagaagccctgataaggaattaaagccattttgcctaactttgtccctggtctttccaaatgaaaactacaaatatttgaaaacaaaactaccctatagtttgttgaacggtgtttttatggctctattacagaagtatccagcatacttgcatttttcaagcacacaaaacttaaagggggcatttttgtttacttttcctacctcattttcagcagtattcactctattcccactgtttcctgccacgcttccccattacacgattttcttcataattgggccaaggtttactctagtaacattagctgtattgatttatttgtacatttgctgtctcgagaacttaagtaatttgagtagctcatattattgtttacatgttcaattatcttgtacttcttaacattttcaatgccattgcctttattctagtatcttttcacaaatatgcattactgtattaagtacaatgtgtccaaaattaattgttaaaggtatgataccagtatttgttcccccaggactcttcgatgaaataaatcagtaaaagaaaatctaaatgtataatttataaatttatagaaattgagaaatctgaaaaatgtagtgatcacctaatctaaggccataattttatagataagggaataggtctccctaggccattatccttgattccaacatctccattgatttattttgggttttatgtgttttctgtcattgcaaggggttcagggaaaaagatagcaactgtgtatgtccggtaatccctcttaaacaagaggaaaaagggaaataatctgacatcccaacttaaatcaggggcaccagtaatctcacagtaatttaaaggtcaaagtttacagttatcttaaatttttatttaaatctccttcctattcacctggccactgtaaagattaaatgaaagtaatttgtagactataaaatgttatatgagtcaagattttgttaatattgctattcttcatcctttcccttcccacggcacaaacatagagccattatggccttacatcaaaattataacacaaaccaataaagcccccatcccctccccattgcaacccatcctataagacaactttttgtactagactttcaattctttcaaacttttaagaaataaataacaccaattatatcagtctattttcacactgttgatgaagacatacccgagactgggaaatttataaagaaaaagaggtttaacggactcacagctccacgtggctaggaaggcctcacaatcatggtagagggcgaaaggcatgttgtcttacatggcagcaggcaagagagagaatgagagccaagcaaaaagagtttccccttataaaaccatcagatctcacaagacttactcactaccacgggaacagtatgtgggaaaccacccccatgattaaattctctcccaccgggtacctcacacaatacttgggaattatgggagctacaattcaagatgagacttgagtggggacacagccagatcataccaccaacattacacctactcttccagagaacaggaaaatataaaacacttccaaatgtgtgttgttgttgttgttgttgtttgaagccaggatagtattaatatcgcagcctcacaagaacattgcaaaaaagcaaagtcaaaagcaaatcctaatcgtgaacatgagtacaaaacacctgaacaaaatttcagcaaatcaaatcctgcgatatatagaaaggataataaaccatgatcaagctgggtctattctaataatgtaatatcatttactacagtaacaggatgagggagaaaaatcatatgattatctcaatagatgcagaaaaagcactctataaaattcaacaccaattaatgatttttaaaaaagaaactagcaaactggcaataaaatgaaactgccttggactgataaagcaaatccaaagaattcaaaagtcaggatagtggttgtcctttgggagtagtaaatggaatgagtaagaaaagagcttcagaagagctaatttctttatctgaatgcttaaaacccaaacgtggcaagttcatgagaatttactgagctgtacaaatacagtatgagcactttcttctatgtatattatacttcaacaataaaaaaacctatagcagtcatacttaattatgaaataataaaagttttcttcttgaaattggaaattacacaagcatgccactaacaccattgttcttcaacaatttattggagatcctaggcagtgcaataagaaaaagaaatagaagacatgaaggacgacaagaaagaaatttcatgcagaaaaccccaaaataatctatggataaagtattagaataaaaatacatagcaagattattggatttcaggtcaaaatagaaaatcaactgtttctatatatcagcagttaaaaaaaaagtttttaaatgacaccatttataacattaaaaatatccaacacttcggaaactaatggaagatatgcaaggtccttacagagaacactataaaacattattttaaaaatttaaggaagaggccgggtgtggtggctcaaacctgtaatcccagcattttgggaggccgaggcgggcagatcatttgagatcaggagttcgagaccagcctggccaacatggcgaaatcctgtctctactaacaatacaaaaatagccgggcatggtggcaggctcctgtaatcccagctacttgggaggctaaggcatgagaatagcttgaactcgggaggcagaggttgtagcgagtggagattgcgccactgcaatccagcctaggtaacaaaatgagagtctgtctcaaaaaataaataaataaattttaaggaagaaataaatggagagatatatcatgctgatgaaagagaaaatactgaaaatgtcaatttctccaaattgttctatagattcaatgtgattccaatcaaagtcccagcagaatttttgtggaaattgacaagatgattataaaaattaatataaaaaaatcaagagaattttgaagaagtgggaggaggtacaccatcagacaactagaataattaagacagtatggtattggcacaaagataaatgcatgaaccaatgaaacagaagagggtgcaaaatagactcatacatatattttaaaagattgggctgggcacggtggctcacgcctgtaatcccagcactttgggaggctgaggcaggaggatcacctgaggttgggagtttgagaccagcctgaccaacatggagaaacccatctctactaaaaataataataatacaaaattagccaggcgtgctggagcatgcctataatcccagctactcgggaggctgaggcaggagaatcacttgaacccgagaggcaaaggttgtggtgggccaagatcgcgccattgcactccagcctgggcaacaagagtgaaactttgtctcaaaaaaaaaaaaaaattgtactgcagagccacagagaaacaatgatcttttcaacaagtggtgctggttcaaataaatatcaatagcaaaaaatgaaaactgctatatgcctcacatcatataaaaaaagaactcctaatagatctatgaaaaaataataaaatatcttaaaagtttacataaatgaataactcatgacctttatataagcaaaattttctttttctgtcctttaatttcaacttttttttcttgctttttttataatttcaacttttattttagattcggggtagatgtacagatttattacacagatatattgtgtgatgttgagaattagggtacaactgatcctatcactcaggtagtgagcatagtattcgatagtttttcaactcttgctccgccgtcactcccctttctagtagtccccagtttctattgttgcaatctctacgtccatgagtacctaatgtttagctcccacctataagtgagaacctgtggtatttggttttctgctcctgcattaattcacttgggataatgtcctccagctacatccatgttgctgtaaaggacatgatttcaatcttttttatggctgtatagtattccactgtatatacgtatattttctttatccaatccaccattgacaggcacctcggttgattccatgtctttactattgtgaatactactgaaatgaacatatgattgcatgttctttttggtagaacaatttattttcttttggatatagacccagtaatgtgattgttgagtcaaatgatagttctaagatatttgagaaatatcccacctccacaatggttgaactaatttacattcctaccaacagtatgtaagtgttcccttttctccacagccttgccagcatctgttgttttttgacttcttaataacagccattctgagagatggtactcattgtggttttgatttgaatttctctgatgattagttatttgagcattttttcatatacttgttggtcacttgaatgtcttcttttgagaattgtctgttcttgtattttgctcactttttagaagggatatttggtttttgctttttgaaatgtttaagttccttatagattttggatattaaacatttgtcagatgtatagcttgtgaatattttctcccattccataggttgtctgtttactctgttgatagtttctcttgctgtgtagaagctctttagtttttaaattaggtcctactcgtcaatttttatttttgttgcaattgcttttgagacttagtcataaattctttcccaaggccaatgtccaagatactgtttccaatgttttcttctaatatttttatagtttgaggtcttacatttaaatctttaatctgtcttaatttttgtatatggtgaaaggtaggggtccagtttcattcttctgcatatagctagctggctatcccagcactatttgttgaatagggagtcctttccccattgcttatttttgttgaagatcagatggttgtaggtgtgtggcttcatttctgggttctctattctgtcccattggtctatgtgtctgtttttgttctagtaccatgctgtcttggttaccgtagacttatggtatagtgtgaactccaataatgtgatgactctggctttgttctttttgcttacgattgctttggctatttgggctctttttttagttccacatgaattttagaatagtcttttctaattctgtgaaaaatgacgttggtagtttgataggaatagtattgaatctgtagactgctttgggaagtatggccattttaataatattgattcttccaatccatgagcatggaatttttttccaatgtttgtgtcatctataatttctttcagcagtgtttagtagttctccttgtagaaatatttcacctccttgattagcagtattcctaggtattttgtttttgtgtgtgtagctattgtaagtgaaattgtgttcttgatttggccttcagcttgtacattattggtgtatagaaatgttactgatctttccacattgatttcatatcctgaaactataatgaagtcatttattaattccaggagccttggtgcagtcttacaatgttctaggtatagaatcatatcaccagcaaggagagacagtttgacttctttttttcctatttggataccttgtatttctttctcttgtctgactgttctaactaggacttcaaaattttcttaaattgaatacaaaaaacactaactacaaatgaaaagattgataacttgcattagctaaaattaacaactattattcgtcaaagacaacattagaaagtaataaggcaaaccacagatgggaaaaaacatatgtactaggatggctaaaattaaaaagattatcaataccaaatgttttggataagaactactcatgtatttccaggcggagtataaattttttacagccactctggaaaaatatgcatacactataacctagcaataccatttttagatataacagaaatgtgtatgtatgtgcatgtgtgtgtataccagttagaaagaagcatgagggtgtttcttagtactggtaatgttctgtttcttattctagatggtacttgcataggtcttttgcttcataataattcataaagctgtatacttacagtcagtgcccttttctgtatgtatgatatacttcaatttttttaatcaggggaaaaataaggagagaaaatcaccaatgtgaaacaaatatcagaaatgcccatccaggaacctgaaatcatttctcactggcacaaacactacccagtgataaaataaggacttgatatttagacaacaacaaaaacctgatgtttcagtttatctatacagccttagtaaatgtaagtatgtaatttcattaagctttctgaaatgctaaaaacaattttaaagattcttattgtttttgtgtacccttttgtattcacagatcccagattagaaattagtgccctagtctgaaaagaaggatcaccagacaaaaatattcagtaaatgttgcctcttctctttataatctatatgttaggtttacactgaaaactatctctttagggaaattatatagatacaccaatcctaagtaaacatttttaaataaaatgatgagggtcttattctcaattgtttccaacactagatacattataaaaagaagttttgtccctataacccccaaatctatgttctttgttaatcagtgtgtcacagttcaaatcttaatcacatccaaaattttgtgaccttgggcaaatttcttaatctgtgtttcaatttccatatctggagaatggggatgatgtgactaatacctacctcatagggctattgtgaagattaaatgcaataatgcatgtcaatcacttagcactgtgtctaaatgttaggctattattattatcaccatcatttttgcctatttatttattttttaaagtaaaacactaaattgctgattacaaatttgtgagcatgaggaagactgttgacataagggcttcattctcagtgatcatgttaggaagtaaccttgtactgggggatttctagatatcagtatatgaagtcttctttggagccactcgattctttcaaagaagaatacatttttctcctaacctggaaagtgctgtctagttgatgatgctgtgcaaaggaacaggaagaggagtttaactgctccatagatcaactttctacctatccctttgtttactgcttaaagactcattccctaccctcagctctacctcgtagttccaagcccttcaaatatttaaagatagccgttattttattctgagtcttctcttctccagttagacatacccatctcctttaactatttacagaccattctctttcatcatcagtatattcattcaaatctctgttattgtgatggttaattttatgtgtcaactgggctaggccacagtacccagatatttgatcaaagattccatgatggcaatttttaaatgagaataacactaaatcagtagactttaagtaaagcagattgccctctgcaatctaggtaggcctcgttcaatcagttgaaggccttaacagtctgacctccctaaaggaaaaggggattccaccagcagaccacctttggactggaactgcaagtcttccctgagtctcctgcatgctggtatgctctgcagattttggacttgccaaatctccataatcttgtgtgccaattccttaaaataaataaatctctctctctctctctctcacatatatatatatatatatcctgttggttctgtttctctggagaaccttgactaaaacagctatgcttcaggaatacaagtagaaaacactacctacctttgtggatatgccagtctaacctcactttattatatccaaataactcttaaaactgtttctaggtcacatggacctatgcaatcagaccaatgcaatttgaccataatatagaataaataaactgcaatttcacctccctaatataattattttaccgcaaccaaagagcaacctaatccacatcactgcttatattgagtttaccataataaaatccccaaaaacttcccacaagaactgttacagctcaccaattctgtatttgtgaattgttttggggggcctgcacataatacctaacattttttcctactaaattttatcctctgaaatttagtttttcattgactgctgtcaagatattttggattccagattctgtcatttcaatacatttacaaatactctcagctccatactaatgaaatattagtctttatcaaactaaaagaggcatagctaagatcaagagaagtctctgacatcatcaactataaacaaagcctgaattcaaataatactgacatacatatgctgctattaaaattctcagggagtattagatatgcaaggaaggtgggacatatgctgctccagacaggcctggtgtcaactgctgtctctaaacttacaagttttataactggacaatttgcttattcctcaaagagtttcaatttccttttcaataaaatggtaaagataaaacttacatcacaagactggtgtgatgttcaaaatacacataaagcacttgacagaatgcctaatacattgcaaatacttgacatgtgtctactttgaagcacgtattatagtaagaactcagcaaaggtgagatacattcctgcttcatcactttcccttggatcaactataacctaaataacttaacctctcctggccttggggtaaagaggtagacagagggggagagaggcagatggaagaataaagttgctgcatgaagttgctacctaaagagactattttaaaggctgagaatcctttaaaagatatcaaatagtttagaaagatgctttgacttgggctgttagaaaactgcagcttctagtcagaaaagaataaatgcagtgatgtttgggatttggttaaacatttaaattgcatttcaaaatgttggatttggcaaaatttaaaataaattttgccaagtccttaagttttttacttgcatgtattcaagggaaagccagcttgtagatttgaatcatttagatttaactcattaaaatgtatagagtgctttatcaagccacaaaaattgtgccccaaatcatttacagtttaacttagaaaaaaaaaagtcttatataaaccacagctcttgtacactaagttgctgagacttagaagaaaagattaactcagaaagacctcaagaaagaaagaaattttgaagaagtaatgaaaggagtggaatagcactgaatgcacaggaaatggaaaaccattccaaggatgcagacagaagtgatattacataatagctgacacagactatatgcaaatttcagtgattggattttgacttaaagatattttcctgaaatgtctggaagaacaatgggactttgggggcatccataaaattataatcaagatctattcagcagatgtttactgtgtgtctccacgtgcaaagctctctaacaagcactgagaaacaatgctgaatgggacagacatgtccttgccttttggaagcttacagtctattgacaaaatagacttttttatgtgaaaacagaaaataataagggctaggaagtatcaagatgtaggaagcagtcgcattatacacggattttaaggtgtaacataaaagaatcatacattttcaatttcttagggactttgaagttcatcagtccagtttttccaagaggaatccaagacagcaatatgtaaactgcttcgattgaggtagggggcaaaaggaaaagcaaagccagacctggacacaggtgtcctaactctatatcaaacatccattccttcattcaacttttacgtgatatttactatgattaggcactgtgctaagtgctgcagaaaaggtaaaaattaaaaacacctctccctaacatggtcctggaagagagataagtatgaaaataaacaatccccaaaagataaatgatgtaacagaaaaattgcacaaagttgtgcagcacccaaaagcaagaccctctctgcttaggaagacaatggtggctttacatcagccaaatcatataaaatgagtaggattttcccaggaacataaaaagaagagaattcaagaaagaagaaagaggccaggcgcagtggctcacgcctgtaatcctagcactttgggaggccgaggcaggcgtatcatttgaggtcaggagttcaaaaccagcctggccaatatggtgaaatctcgtctctactaaaaaatatatatacaaaaaaattagccgggagtggtggcgtgcctgtagtcccagctactcgggaggctgaggcaggagaattgcttgaacccgggaggcagaggttgcagtaagccaagatcatgccactacattccagactgggcgacagagtgacactgcttctcacaaaaaaaaaaaaagagagagagaggaaagaaactgtgcaaagaacactgtatgtttggaaaagtataagtataaaaagtatgagttcttttacttctgagctttttttcttaattagttttatcaaagtaatacatgcacatagtcagatggtgcaaaaagactcgaaacacagcagtcctgtggccacccttctgctggttacactaccatcaaggttctctcagtcccagatgcaaccatgttaaattggtttagctgctgcttctggcatttagcgccatgcttctaaatcacgtgtgtctatactgatatactggtatcctacacagtataagaactttcacctcatacccacttcacccccccaccccagtccccaatatggttgaaacataatgtggggtgatatccataattgtagttataatgactaagtaaatattgcttgctgattaaggtattatactctgactatatttcctctctgtgataccttttcctttttctaatgttgatttgcatgtacttgattgttctcttctactctctggtttaatcttcccccacattccaatggctctaaagccatttctaaataccatttttcttatagtcaaacctatcagataatctatttttccccatgattatgccccctagaaatctgcccctgtactcaccccttggcctgtcctaggaattccttctgtctatggtgtaaaccaagaaataggaagcctccaaatctaggaaacataggctctaacaatctcactttgatagaacccacattctactagcttcctgagaaagaatgcatgagaggtaaatttattttcatacatttgtcagtcatccttgactgatattttaacaatgtaaacaattcaaggttgaaaattgctttccttcataattattatcttctagtttctagcgttgatttgtggggcttttcggcttctcaaagtatgagttaggattgtgtttagttgtaggtaaaataaaatccaacaagttataacttagccaaatagggaacctgaccaggtgctgaccacacctgtaatcccaactctttgggaggccaaggtgagtggatctgctttgagcacaggagtttgagaccagcctgggcaacatggcgaaaccccatctctaccaaaaatacaaaaattagccagacattggtggcttgctcctgtagtcccagctacatggaaggctgaggctggacagtcatttgagcccaggaagtggagggtgcaatcagatcactccactgcactccagcctgggtgacagagtgagaccctgtctcaaaacaaacaaacaacaacaaacaaatagacaacctcccacccccaatgtaacaagaaatccagagacaggtagttgctgaaattgattcagcagttcaggtatatcagagctgagaactctgtgattctcatggtcgcaaaatactgtagctccagacatcttgttcaggtttcaaatgagaaaaagtagaagagaaaggagaagattcaacagatttccacttacattttatgggccagcactttaccacacttggtcatatctaactacaaaggaattgaaaaaagtaagcttttagctttccggcctctacaatgaagaaaagcaagggttgaaagagacaaactggaatatgagataacattacaatgtgctttggtgtgcgtcttttcaaaaatcttttgtgctgggcactctttgagtccttctaagtttgaaacacatattttcagtcctagcaattttccttttaaaatttagttgatagttttatcctttttgttttttcattctctctggagagctcctaaaagtcaaaggttgaacttctgatactgatcatctatcttttttctcctatttcccatctcattatctttcacttcttttttattttaagttccgggatacatgtgctgaatgtgcaggtttgttacattggtattattttttacttcttttttaggagacttcctcatctgcatttaacccttttattgaatattttatttcttaagtgctttcttactctcttattcttccttttctatagtattatgtttttattttatggttgcaaaatcttctcatctttctgagggtactgattataattccttgaagttttcttctttttcctgacagtctttcttctgagctttattttgttattgttattgtttatttctttgttagttttgatctcttttcctgttggagtttctccttaattgactggtgataattgattctgtgtcatatctaagaatgaggtactagaagggtgactagaagctgcgtgcatgtggccaaagcttaatgagtagtaagctttactaaaggacaatcaggaagcccgttagtttcctcatcagggaagcccacatgtcagtatctacagagtttttctctgaagcatgttatcccttcagagaaggatcacctatctgaagaggtgttaagagagaaaggcagttataagccttgctgctactgttgtagaactcagcacaggaaggcagctagaagtctcaccattatgcagatcacttaattcccctcactcctatcctccctactttgcagtctctcaggttcagttcttcacagattatacgtttcatatgcagcagagacagggaagtggcagttgttagtgcctagtagggatgactgaaaaatataattaattttaaacaattcttttgtttgtatgccacccacatcatctctccctcacaatcacactccaacttccataatacctaatttctgattcctaagcctatctcagattctgcaggatgaatcagtttgtttatcattggtatatccctctgcagataattagattttacattcttgctgctaagttatctacaattcttccatatgctttcaattttcctatactacagatgaaggttagagaaatctagttttcctaaagatggaaagtacctgttgcttttgtttgtttgtttgttttaagtgatttctagtaaagaagtactttttctgccattttgaaacaggtaagtctctaattatgaatttaaaacttgaagacattgatagatatgaacaaaatatgctccagagcaaaactctacccattaacaaccagatcatgcacgaccagattagaatggccattatattgttggttatccccattctggtaatatgacgtagcagctaagagcatgagctctgaggtcagattgcctagccttaaatcctgtctctaccactttacaagatgcataatcttgcacacattctgtttatattatcctcttgacctgaaaaaatgtagagtgatgatgaggattaagtgaacaaaatgcctggcacacaagtattcaatatatacaaactactattattaactccaacagatcaaattttccaaagtagtgagagtaatatgcactaagcgccttacagatattaacttactgaatcctgaaaacaatactatgaggtagggatatcaccgtgccaattttataaaagataaaactgatagatgaacaggttaaataacttgcccaaggtcacacggccaaaagtagataacagggattcaatctgaagaaatctggttccatcgtctttgatcttaaccacttacaatacacagcccaaggatagcatcattcaaatttgagtccccaggttctctctagctctcttatggaatgccaagtaagttatattcggtaccacagactaacttaaaggaagatttcaaaacgacactgcaaaatttggaccaaattatttctccatttaactgccttctatgtacaggtagtagtatagaatagttgtgtacatgtgatgctcatttccataatgagtaaaggacataaaacataaaaatatcatgcagtttttaggcctattgctcccaaatcattcactctgattatatcctttattacagggaaatgtgttttctaagtctatcttctttgcatggattgaaagatttgtgaaactgaaaactaaccttcctctgccaagagccccatcaagacagaagttcttaattaactaagcaattagtcataacaagtgaaagctaaaatggagcatgaatacataatttgctgattatttttctccactagaacccttagccagaatttaacaaaaagtgttctgtgggtgctagttttgggaaggatggtaaaacctggacagaatgcactgaacagctatttgagggctccaaagagtaaagaattgcagatggattggagaagaccagaattcaaagtatcagcagtgcgtttcttgtttttccttagtatcccccagtctggtgtctacacctggtacaccaaaaccaggagtagacaccagcatacaaacagagagatttccagagaagtcctctagctctggctcaacaggtaggaaaacaaagagatttctaacactcagagagagtgggggaaattccaggtttttctcttatatcatcattattacttatgttttctctctttcatgcctcagtctccaggccatcctgtggcagtggcagcagcaacaatggcaagcaatggagtgattcacaggtgcctgaaacttggatagaagtgtagtccacaagagagaggcaaactcctactgctttttctctctatctctgtttacctacctcttgaacctaaacatgggtacaactacaggatgtgtgtggcagagcaggataactaaaactccagtttgtggccaaggaaccaaaaaatactggggatattgcggagaaagggttgggatatgagcccgtcctgagctgcacatacagagatatgatcttgaacacctaacaaagacttgagaaatgaattaaactactgaccactacccagatctcagactggctgcttggttgcaaatatgtgggacagagcaaaagagcatcacagagcgtttgaaaacgaattgacactgaaaccacaagccactgaaggctgatcagaccttacaacctgaattctctgggttgattgcatgctaaaataaaaatatcaacattcaccataggatgtaaataagacccagagtctcataacatgatattcaaaatgttcagaatataatacaaaattactcagcattacaaagagccagaaaaatttcaaattacatagaggaagaaatttcacagacatcaatgccaagatgatacatatgttagaattacctgacaaagatgtcaaagcagctattaaaaacactcttgaaataaatagaaagtttcagcaaggaaatagaagacgtgaagaagaaccaaatggaaaatttagaactgaaaaatgcaatagcaaaactttgaaaactcactgaatgagttctgtaacagaataaaaatgacaaagtatcaataaacttgaaagcagatcagtataaattatccaatctaaacaacatagagaaaaatactttaaaaaataaataagagcctcaggacctgtaggacaatatcacaatgcctaatatgtatatcatcccagtcccagaaggagagaagagagagtatagtacaaagaaaaacaatgtaattgctaaaaactgaccaaatttgccaaatgacataaacccagaaattcaaaaagttcagtgaactccaaaaagaataaaccccaaaatacccatacctagacatatgataatcaaacttctaaaaattacagaaaataatgttggaaagtaaccaaagaaaaatgatgcattacttacagggaagcaatgatttcaaagtctgaggatccctcatcagaagtgggagctaagctatgaggaaacaaaggcataagagtgatataatggactatagagacttgcgggaaagggtggggaagggggtgaaggataaaagacaacacaatgggtgcagtgtacactgcttgggtgatgggtgcactaaaatctcagaaatcaccacctaaagaacttatccatgtaatcaaacaccacctgttcccccaaaactactgaaatcataagaagaaaaataattttttttaaaaaagaagtcatggaggccagaagaaagtgcactcatttttaaagcactgagaaaaaggaaccatgaaaccagaattctgtatctagcaaaaatactcttcaggactaacaatgagataaagacattcttacatgaagaaacactaagagaattttcattagcaacagacttctctacaagaatgactaaaagaaagttcttcagccagaagataatgatgccatatgcaaatgtggaacatcagaaaggaagagagaacaacaggaatggtaaatttctgggtaaatataatagactattctttcaccctgagtcatttagagtatgtttaacagttaagagcaaaaaacagagcattgtctgatgagattttcaatgtgcaaacagagtccaaaactaggcctacaaaagtatgatcaatgggtttttgacgaaggtacaaaggcaattcaatggagatatgatagttttttccataagaggtgttggaacaaatggacgtttcgaagcaaaaaaacaaacaaacaaaaaaagaacctcacgcattatacagaacttatcttaaaagagaacatagacataaacataaaacataaaactaatttaaaacatcaaatatagttttttgagtaataattggaaaaaatcttagtaacattagtttaggaaatgatacaccaaaagcatgattcataaaaaaaattttgataaattggacatcatcaaaataaaactcttgctctgccaaagaccctgtaaagaccatgaaaagacaaggcatagacttggggcaggggggaatctgcaaatcggccgggcacagtggctcacgcctgtaatcccagcactttgggaggccaaggcgggtggatcacgaggtcaggagttcaagaccagcctggccaacatggtgaaacctcgtctctattaaaactacaaaaattagccaggcgcattggcaggcacctgtaatcccagctacttgggaggctgaggcagaagaatcacttgaacctgggtggcagaggttgtagtgagctgacatcgtgccactgcactccagcctgggtgacagagtgagactctgtctcaaaaaatctgcaaatcatatatcaaacaaaagatttgtatctgactatatgaaaactccccaaacttaagaaaacaaacaactcattaaaaaaaataaatacatgatttgaaagaaaacttcaccaaagaagatacatagatactaggttggtgcaaaagtaattgcggtttttgtgattactcttaatgctgaaaaccacaattacttttgcaacaacttaatagtaaataagtacatgaaaagatgctcactgtcattagtcattagaaaatgtaaataaaaatccacaagaacatgctactacacacctattagaatgggggaaaaacagacaactgcaggtattagcaagtatgcagagccattggaactctgaaacattgctgatgggaatgtaatattacagccactttggaaaagtttggcagtttctgacaaaggtaaacattcatttaacttatgacccagtaattccactcttagttatttgcctaaaaggaatgagtatttgtttcacaaaagcacctgtacatgaatatttacagtagctttattcataaataaaaaatgcatatgtccttaaactggtgaatggatggaacaaaactaattgtggcacattcatacaacagaataccactctccagtaaaaatgaactattgatacacacaacaacatgggtgaatcacaaatgcactatgtaaagtcaaagatgacagatgtaaaacactatataccatataattccatttatatgacattctggaaaaagcaaaaaaacagggacagagaaaagatcagaggttgccaaggattagagctagggaaaaggctgactacaaaagagcagactgaaggcattttcagagacaatggaaccctttagtatgttcattgtgatggtggttacacgattacatatttgtccaaactcatagacctgtacaccaaaaacagtaaattttattgcattttaacgtttttaaattttaaaacaaatttacctatttaaaaaaaaaaacaaagacagcaacaacttaggatcccatattaccatcactatttaatgtgatcttagacaaatcacttaatatagagctttggttcccccaatttttaaaatgaaaaatatagtatttatatctcataggtctttataaaaaagttttttaaaggtttcaagatcctgccttttcacattctatttcttctgaaatgtttcttcccatcctctcttccctactttgcttggctaaatgctatttgattttcaggtctcagcttaaacgttattttttcataaaagcttctcctaactcacattttaaatcagggcctcagctatgcctttactgcccagtgtactcttatttcataacacttctcatgtccttttttttttttttttttgagacagagtcacccaggctggagtgcagtggcccgatcttggctcactgcaagctctgcctcccgggttcctgccattctcctgcttcagcctcccgagtagctgggactataggcacctgctaccatgcccagctaatttttttgtgtatttttggtagagacggggtttcaccatgttagccaggatggtctcaatctcctgacctcgtgatccgcccgcctgggcctcccaaagtgctgggattacaggcttgagccaccgcgcccggtctttttttttatttcaagagcttaggcgtacaagtagtttttggttacctggctgaattttgtagtggtgaagtctgaagttttagtgtacctgccacccgagcagtgtccattgtatccagtatgtagtttttttatcccttacccctcttctactctccttatttctgagtcttcaatgttcattatatcactctgtatgcctttgcacgcccatagcttagctcccacttataagtgagaacatatggtatttggttttccattcctgtgttacttcacttagaataatggcccccagttccatccaagttgctacaatggacattatttcattctttattttatggctgagtagtattccatggtgtatatataccacattttctgtatccattcatcagctgatggacatttaggttggttccttatcttttcaattatgaattgttctgtgataaacatatgcaagcacatgtattttttttatagagaggttgtactaacttacattcccaccagcagtgcacaagcattcccttttcaccacattcacgccaacatctttgttttttgattcttaaataatggccattctggcttgggtaagttggtatctcactgcagttttaatttgcatttccctgatgattagtgagtacatctataggtaaataattttatttaatgtctgtctctttcatgaaatggtaagctctgtgagggaagaaattgttatcagaatacaagcagtacaaagtgtctgaaacactggtgaatattctgtacatatttttaaacaaatgtgcaaaaacacaatggcatttcctattgtgtaattaattctttcttaatatctttacctttctcactatttatatgtatagacacatgtatcttaatgtttttatcttcctcaccctgtatatatacacatacatatatatgtatgtatgtgtatatactatgcataccatcaacaaagtttcttagcaaatgtccatcaaaagataacaaataatagattatgccttggttgacatacctgtttactaacttttcctcatttgtagtcattaacactaattgaacctgacaaaaataagatgtgacagacctactgtatatccacaagtcaaattaacaaattagttgaagaatcaatacatctacatatgagtctactaactgttgggcatacatccagacttacatgcagaaaagcacttaagaaccaaacctttttccctcttatataagctgtcaaaaatgttacagatgtgacatttaagaaactcagagcatgacttatagattaccttatgcataatggtaaaaattcctctagaacaaccagcaacattaataattagttggaactcaattacggatacttgccaaagcaaatccccagaaagctatcttgtatctttcaacctggccttgtagaaatgatctaatgtagcatcctacagtgtaggtacgtggggtattaatatcccaccctccttgatgggtcagtaactgaaacagtgaaaggctcaatgaagatcgcagcactaataaacgatgggacaggtattaatactgcaatgccgcactgtccaatatggtaaccactgagccacatgtagctacagagcacttcaaacgtggctaatccaaatcaagaagtgctgtaagtgtaaaatacacaccagatttcaatacttggtacaagataaagaatgtaaaattctcattatttgtttatactgaatacatgttgaaatgactatgggttggattaaataaaatcattattaaaattaatatcatctgtttcttttcacgtttcaaagtgtagttactacagatttttaaattatatatgtagcttgtattatatttccagcggcatcatgatagagcactcctggatcagtatggttgaataatagaagacatgtggaggcaaacatttaggtttacttcccagactctaccatatacacacagagtgactttgcagaagattattgtatatcactaagatgacttttcccacatttaaaatcagaacattaaatctatgatacagtactagtacgaggttaaataatacattaaaggtctaataatgtattctacaatgaatagccacttgatgttaatttctcttttcctcctttttcctaatccacttccctgttaatttaagctgcagttaaacttccatagtggacagattagtccccatgcctactattcccagtacctcggtctaggttaacacaacctccatgaccagaaaaccaggtacagaatggtggtcactgagtagcccaaagtaggtatgacacaagtatgacctgtctgtagtttggcatagtctaatacaatgggctcaaatagtgaaaaacagcatatctgctcccttcagaattcatccaagaaacagagacagactggttaataacaaaagggtaatggaagcagacgtagaaagagacatagaagtaacaagatggaaaagccattcatttgttcactccacaaatattaatgactgtctatttattacatgctatatgacctgagagaggaagtaacaggggaataattcccagagctttataagacccagacaacttccagttccagtccaaatgtctctttacaataaatattttttctttagatgaatagatgaaggctctgctccttgaaactaaaatgacctaactaacgtagcttcacaaaggaaggcacagaaaagtgcctttttgttagacactcacacacacaaagacaaaatatgtattgccctaggtaataaatcaaacaaaaagggttcttcctcaaagtgggccattcctttcctaaaaccagtaacagacagaacagaaaacaagtggagatagcaagggctactgacccttaatattcctttagaaagccactaccagaaatacacttttaagtgccttacctgcactgcatagaaatatgtaggcaaagagaaaaaagatcggccaactaaaactacagactataagtacttattaaagactactttcactaacataaatgggattcactacatcagagtcccctgatcactttttgcagggcagtctgtgggcctcactaaactaatttgcgatattaaggtaaggaaagaagaatttcctcattctaaatgtattattggacaggcttgaagtccaggtcttaagtatggttacataagggacaacaataactatttgtttcaaattgtatctctttcaataaaacaatatctcagtggtttcagcagggagtacaaaatctgatctcttaaccctaaaattccaaccctggaaaaatggctcaccttcgccaaaacacacacacacacacacacacacacacacaactagagactgattttccacacaaaatttatgtacttattaaaaaggaatttactttataattatgtgcaagaattatcatggtgagaagtgaatgttggttttaatcattgccagtagatcctcccatcagccacataatcatattcactttatggaggaagcactattactccgtaccaagcatcttatataatatagctctttgttttcatccctgtgacaaaccatgtgagatggctgtgtgacccttgttttaaaaacaaggaaactgactgctggaaaggtaagtaacataattatccaagatctccaacctaacaaatgtcaaagtatgggagctgaccttgggcttttatgctcttgtccacaataatccagagcacccagaacatttatatctctaagaagttaagtttagaaaaatgcatctttttttgcatatatgtcaccaacttcgggtatttcttattacaagagacctttttgcttaaagattccaaatcaatcacccatcatttttctaacactataaattctaaatgcaaatgtcaactaagaaaggtctatgaacattttaaaaactcattttccccaaatccatatgagtctgaatgctgagaaattccacactaaaggtagaatacttaacaaaacaccaacatttcccttcagaaataacaaagggaaatataagtttgtgctcactttttcataatgtcatggcatgttaaaagatgaaaacctagtaacaaagtcaattaatagaatctacaatctttttaaaatattttagtagcttaagaagcatattaaaactagaacctaaatattaggctggaatcgtggtacatctttagctcttccagaatcatactcacagtggggctcacactgtattttaataagcttctaggtgggcccattcatctagcagcttaaaacctccccaggtgattccaatgtgaactccaggctgagaactgtcatagttgaaaaccactggactggcacatgagagcctgatttctgctgaatgtcctttctttgagctcttctcccccagtcctatgaaaagcatggtcgctgattaactcagagttaggtgaagaaaatcaaacttggagagataattataatagataccgtgatggttaattttgtgtgtcaacttgactaggctatggtgcccagttgtttggtcaaacatagcctccatgttgctgtgagggtatttttaaatgtaattaacatttaaatcagtagacttttagtaaattagattaccctccctaatgtagatgaggctcatacaatcagtcaaaatcttaagagcaaaggctaaggtttccagaagaggaaggaattctgcttcccaaatgcaacactgaaactctacctggctttccagcctgcctggcatgtgctgtagatttcagacaggactgcaacatcaactctttcctgaatttccaggctcccagcttgccttacagattgtgaacttgccagctcccataatcacatgagcgtattccttaaaataagtctctttctcactcgcattcatggtgtgtgtgtgtgtgtgtgtgtgtgtgtgtgtgtgtgtgtgtgtgtgtgtgtgtattctcttgtttcaatttctccaggggaccctaatgctagataccattatttaaacacagactatgtactagaaaccatgctaaattattcacatacattttctgagttagcctttacacaacccaattaaacagttgaataagcaagctataaagagaagatgtgaccagagatagggaagcttcctttagtggctgtggagagcaagcagtacagaagttagcactaggtgagccaagaaaaagccaaggacaaaagaagataaggtgttcattgaaaaaaacaaaagacaaaagggaaaggggaaacctatagatttaaaaatacagtgcccaccataggaaaccattcttctactttctgcttttattgctttgacttttatggacattacacttaagtggaatcacacaacacgtagtcttgcatctgactcctttaaagaagcataatgtttttgaagtttattcattttgtagcgtgcatcaatagatcactcctaaaacttcttgaatatagaagtggaatcatgtagtagtaggtctatgtttaaacttcaggaaactgtgaaagcagttttccaaagtggttgcaccattttatattcttaccagcaatgaaggttccacgttctccatatcaatgccaaaatttattattgctaactttttaaattataaacaattgagagtgtgtgtgtatgtgtgtgtgtgtttgtgtgtgtgcagtgtgtactatatagaggttgtttatatctcattgtgatttttttaaaatagagacagagtcttgctatgttgcccaggctggtcttgaactcctgggctcaagcaatccatctgattctgactcccaaaatgccaggataacaggtgtgagccaccatgcccggccctcgttgtgattttaatttgcatttgtctaatgactatttatgttgagcatattttcatgtgtttattagccatttgtagatcttcttcagtgaaatgtctattagaatctttgactattttaataaactttggatattggtacttattttaataaaccaactgtaaaatatgtttatgataaaattgtggaaatttaaacattcaaaggatacttgatattaaggatttattagggttgttttgggtttgataatgctattgcagttatgcttttagaaaaaaatctttaccttttaatgtgacacactgaataatttatagatgaaataatgtgaggtctgtgatttgctataaaataatccagaggaggtaggggaatttatataaaagattggccatatgttgacaactgatagttcttggagctgagaaaaggattcatggggactcataatactatgtttgaaatttccataataggtttttttgtttgtttgtttgagatgcagtctcgctctgtcacccaggctggagtgcagtggcatgatctcggctcactgcaacctccgcctcccaggttcaagcaattctcctgcctcagcctcccaagtaactgggactacaggtgtgtaccaccatgcccggctaattttttgtatttttagtagagacggggtttcaccgtgttagccaggatggtcttgatctcctgacctcgtgatctgcccacctctgcctcccaaagcgctaggattacaggcatgagccaccatgcccagcccacaataggttttaagaaataaaagctgacacaccgaatgcatgcattaacctacatatacactctctcaaaatctactaaatacaccgtaaagggattttttaaggcataagcaacaagaagaaaaggaatgggaatgaagacaacagcaacaaaactttggaagctagaaagtatatggatgaacatgaaccaacttgagaaacctgaatccccaaccagaagtggaaaaagccaagaaaacaacctgatttacacaacaaaaatcttcaaagggtttaggaataggtggcatcaggtacatctctggagataagtttgaaggtggaactgaacaccaaggaataactgaaagtagatttaagaaaatgaacctccagatattttactacactctacacagccaaccaaccacccctctcctactccagcaaatgactttggcttattttctgcagagtcaaagagaggttctctgcgatgaagaatccaagctacggttgagggtggggacaaaatactaaaatgaagaaaataagtaaaagtctacagattgaatatagagacttcttcctcagttcagctcccagaatgcttatagagaggctaaaagattagaagaatctggatgtccaacaagaaagactaaaagatgctgacattagaggaccccccaccatgtctgctcactccacagtaataagcttcacccacgcacacagagttcgcactagctttacagagcccaaccttttcttctgagtcattaattggtagagataacttattggggttcagggggttgatttaaaaattgagaactataggccgggtgcagtggctcacaactgtaatcctagcactttgggaggccgaggcgggcagatcacaaggtcaggagatcgagaccatcctggataacacagtgaaaccccgtctctactaaaaatacaaaaaaattagccgggtgtggtggcgggagcctgtagtcccagccactcaggaggctgaggcaggagaatggcatgaacccaggaggcagagcttgcagtgagccgagatcgcgccactgcactccagcctgggagacagagcgagactccatctcaaaaaaaaaaaaaaaaaaattgagaactacagaaaaagttacagatttatgactatatgaggaagtaatgaaaagccatttcatgaagcagtggtgaatcaagtttttactatatgttacctcttgggagaatagtttatactaaattacttgttttattaaaaaaagaaactatgccaaaaaagaaaaacaatataaatggtcaaatctaatatatttttggctttctttttgacaaactgtctgtaaaaatggtgtctattgttcccatatttatgaccatgtgtatccaatgtttagcacctatttataagcgagaacatgtgttatttggttttctgtttctgcgttaattcacttagaataatcgtttccagctgcaaccatgttgcctcaaaggatattattttgtccttttttatggctgtgtagtattccatggtgaatatataccacattttccttatccaatccaccactgacgggcacctgggttgatctcatgtcttcgctcctgtgaatagcactatgatggacatacggagcccaacttttaaatacaaatggacaaccaaggatcacaggacattttagaaaagccccaaacatgaaaaatgaaggctgaaaagtgaaaacctgaagagatttgtaaaataaacctaagtgttagataaactgacaaaatttcccagaaagtaaagtaaaaagatttttaaaggtacaaatggacgagcgcagtgactcacacctataatctcaccaatttgggaggtcaaggtgggaggattacttgagccctggagtttgagaccagcttgggcaacatagggagacccccatctcgaaagaaagaaaggaaagaaaggaaggaaggaaggaagggagggagggagggagggagggagggagggagggagggaaagaaaagaaaagaaaagaaaaaagaaaattagccaggtgtggtagtgcacgcctgtagtcccagctactcaggaggctgagacaggaggactgattgagtctgggaggtcaaggctgcagtgagccatggccatgccaccgcactccagcctgagcaacagagcgggaccctgtctcaaaaaaaaaaaaaaaaaaaaaacaaggtacaaatcgtgcttgatttaccatggttcaacttacaatttttcaactttaacttggtgcaaaagtgagaggccttcaacagaaactatacctatacaaccattttgtttcagtacactattcaataaattacataagatattccatactttattataaaatagtctttgtgttagattatttcaccccactctgtgatccaacaattcattatatccaacaatttattataaatatataataataataatatatccaacaatatattgttggatataataaatatccaacaatttattataaaataggctttgtgttagatgattttggctaatgtaagagttctgaacatgtttaaggtaggctagactgagctacaatagtcagtaggttaggtgtactgaatgcatttttgaattatgatgttttcagtttacaatgggtttatcaggacataatcccatcacaaatcaaggaccatttgtataatagttaattttatatgtcaatttggctgatccacagtgcccagatatttggtcaaacatgattctgcatgtttcttggcaaacatgtttttcgatgagattaacatttaaatctgtggattttgagtaaagctgattattctccataatgtgggcaggtctcatccaatcagtcaaagaccttagtagaacaaaaaatgaccacccagaagcaagaaggaattttgtcatcagactgaaatatgtattagtcagggttctccagagaaacagaaccaacgggatagagaaatctagaaaaataattactataagttacctagaggctgagaagtcccatgtggcgaaatctccacaaacacatgaaccaattccttaaaatcaatccatcaacccccaacccgtgtgtgtgtgtgtgtcctttcgattctatttctctggagaaccttagtaatataggatagtaagaaataaagcatttaaaaaaggaaagtcaaagccaggaggtcaacatcttaacaggatatccagaaagacagaacagaaaaaacaaacttgactaaatcaaataaataattcaaaaaactaccccagaactgaagaacatgactttctggattgaaagggcccacagagtaccaaccacaaaaaaaacagaaatagatccacatgaactacctgcttaacacaccagcacacctccctctaagaaggccaaaacccttactcagagtaattggcctacaatttcagcctcttttctatggagtccttcggttctggaaaatactcctgagattgatgaatagaaaagaaacaagagcaggcaggactctgggccatctgcccctgcttcatttatagaagccctgcttttacgtttcatattctagatttttggataagtttttttttactttgcatttttgcattggctattttttaattgtatctctttaaggtatataacatgatgttttgatatatatacacatagtgaaatgattactgtaatcaagccaattaacatatccatcatctcacactgttactctttgtatgtgtgtggtacaagtacctaaaatctactctcttagcacatttccagtatacaatattattaactacagtcctcatgctatacagtaaatctctgtgcttacgtgtcctacataactgaaattttatactctcgttgacctccatctgcccatttctcccacacccttcattcctggtaaccactcttctattctctgtttccatgtacttgaagtttcatttcgttttgttttgtttagatcctacaaataagtgagatcatatagtatttttctatgtttggcttatttcacttagtatcatgtcctctacttccattcatgttgttacaaatggcagtaactccttctttaaggctgaataatactccattgtgaatagagacaccacaatttctttatccattcatctatcaatggacacttgggttgtttcattatcttggatattgtgaagaaaacctctttctttttgctctttaaatatataaagagccatctctggtgcaaattccaaaagaaccgcccatgaccaagactattcctgctggatcacacctcatcctttccctagctcccaacaatgacatctagaatattatactgaattacatttcaggcctttgtggtctagcctagaacttaaatgtgccttaagatccaaacaagcagcttttaaacaaacttttggaaaatgctctctattcataaatggaagctctctgtgcctacggaatagaagcaaattcatttattaatagtccctaggtcactcataattagtgcaaaactagtctgttaactaggcaacccctgaggcttcaggaagtaattcatttatgtgtttgtttttcttcaatatttatagttgttgtcttgcacaaaaatctatctcacagagatgtctgaaatctcttcactggtcattaactactctgataaacattatttacttttctcttaaaacatataagagaactagagaaattctgaaagtaaatgagatagcacaaaaaaaagatgaaagaacactgaagataactttggtatattttataaatcttcccagagtctcggcttatagctgggtttaatgccttgacacatacatatttatcaaaattggcagagtaataaaatcaggtgagataaaaactgacatgaacactacaaatacaaacttactatagcttttttcaaaattatattcaaaatggaagcatctaactgaaaattgttactttcattgtacacaaaatgagtatatgtgtatatgggtatatgtgtgtatctctcaaatgcatcatactagcaaatttgagcaatgtttttcacattctcatttaaacataactaaagtcatcctcagtggctacctaatcagcctaattactctgggaattactattaaactagtgaaagccacacaaaagattggtgtaaactattccagattcaaataaaacatatcatttctatttttccattcacagctgccgaggaacaactacacagtcagcagctactagaataaaatcttacagtccattcaaatctaaaaagcaacactgtgcttatttaacaaacaagtatgctatttatctaccatactagtgcttagaacaaggacggggagccattttggctataaagtttagacagcttcaagatgaaggtctgagctaagccttaaaagataggtagggatatagaaaggagagggaagaggagttctaaacgaggacataaagtttgaaaattaaaagttaaaaaaaaaaaaaaaaaccctgaaaactaccatccagcaaacagttttcccaaatgcagagttcttagaagagaatgatgggaaataagattaagtaggtgaaacttacactgagaaataacagaaatatttagatagaagtacaatgatggaaggcataattttttcagtgtacatgtgcatattaaatagcaacacatataaagctcttagcacagtatctggcccataaggctaaacaaatatttgctattattgttgttattattattaactgaaaatttcaaatagtattttctgtagtttggacaactagtaaatatgactaccccgatttttaaaatctagaattaaacatttctatgtacttcttaattttatatacatgatctcaccacaaagccctcaatattactcaaaaggcacatctttatttccctgtacttcaaatcaatttctatctaaacagaaattcagcttggtctttccccaggcaatgataaccttctctgacactctctaatgctgatgtcctccaaacaggactttctgtcctccaaaaagaaaaaaccttccccaaggaacagcaagaaagaaggaagctttataatagatgaatttataggcaagtctgtctcttatctaacttctgtgagtgtccagccctgatcctgtgtctttggtttaaaagaaaaaaagccctgggtaagccaagctcagccctaggcatcctcctcttcttcctattttggccctggcttccatgaccctatctgttttctgtaatttgctacatataatgggtaaatatggaacaacgatgaagaaagcaaagattggaggggggaggttgccaaactgctctccgctttagccccgactttgatataagaaggcaggagagccaaggattaatatcagaggtggtttttcatttttcataacatttcagagcctgaaagactgtaacaagatggtgatgatgatgatgatgatgatgacgacaacaacaacaacatttcacatttatttaggctttcactacataatcgcaaaaacactatctcatattaacaagaataacagctacctggagatcaatgagtctagtcctctcattttataggttagacaacttaatgaagtcagagagattaataactttgccaagactacaaattagtggcattggtgataataacagtgatgataataatgatggtgatggtggcagtgattacgttaataacccactaaattctttgtgtgccttgtctcatttaatccttacagcagccctaggagggaagtactatatttatcttaattttaagctgaagcaactaagaatttaaaagatcaaaaaacttgcccaaagtcacacagcaaataagtggcagaactgagattcaaaaagcagatggactcaaaaatctgtcaagttaaaacactaaactacacttcctgtagttaaaattacaactcgattcttctgactctgatcctagtttaatattgtttccctcatagcctgtctcctaaatttagtgaggtatgtgttgaaatagaaatctaatacgtattgcatttattttctaatatattatctgttacccctacaagtttaatgttacagaatatagatccatctctagctgtaaaaatatactaatatatattattaagtaattagcaatagtattcattttatcaatatgacatttaatcaattttagtttttataagtcagatgcacatagtttatttcaagaggaaaaaaagtcatctcactgttatattcttgcagaagattgccctgtcctaaaatcaggattatttgtagacaatacaaagcagctaaactagcttctcttagaatttccactgtaggaaataaataacaatatacactaagttaaaaataataatgcccttgttatttataatctaccctcagggaattttaaagcacttttcatgtcgtaacagtcttaaaatgtttccaggatatggattggcaaaccaaagtactgtaaaaagaattgtgattttttttttttcttttagatggaatctcgctttgtcgcccaggctggagtgcagtggcacgatctcggctcactgcaacctccgcttcccgggttcaagcgattctcctgcctcagcctcccaagtagctgggactacaggcacctgccatcatgcccggctaatttttgtacttttagtagagatggggttgcaccatgttgaccaggctggtctcaaactcctgacctcaggtgatccacctgccttggcctcccaaagtgctgggataataggcatgagccaccactcctggcataacagtgatctaaaaatcttctatatggccatgtgctgtggctcacgcctgtaatcccagcactttgggaggccgaggcaggtggatcacaaggtcaggtgttcgagaacagcctggctaccatggcaaaaccctgtctctactaaaaatacaaaaattagccaggtatggttgcaggtgcctgtagtcccagctactcaggaggctgaggcaggagaatcacttgaacccgggaggcggaggttgcagtgagccaagatagtgccactgcactccagcctgggcgacagagtgagactccatctcaaaaaaaaaaaaaaaaaaaaaaactatgtgaagtagctccttgcacacaatagtgacaaaaatatttagcatttattcaaagagctataatttccagaactctttcaattcttaccctaatcctgagaagcaagcagggaagattacattatccccacattaaagttaaggaagaactatgattcataatggatacttgtctcagccaaaatcacagtcaccaagaggcagagccaggattagaaccttggtcttctgactcgtgagtcctatatacttgctactctacttgatctttatttcttatataaaagaatgttcagttaatgtttgacaaatgaacgtatgcaatgcatgagcaaatcacatttcatcagaaagaaatgctgaatttctaaatttcagaccagcattttgccattatataattttttctctgtaactatactttttgtttctgaagaatgaggctgtcccctcaacaagtataattatcctctagaaaagcaaattgtctttgagctgataagctgataaacagctaacacacaaaatcactaaatttttctagataaaaatcacgagttaaaaaaatagatatatcttcttagaaatataccaagaaaaccaaatgctataacttttaaccctagtttatagcatagctaaagaacaattactatataaactagacacagttttggaatgaatgaatgaagactcatttataccaagaaggaagaaaagaatcacaacacagttcacccatgatttcacatctattaagtagaaaatattatcatattctcacaactgtcagcctgtgctgccagacttcacatttagcaattatctcaacgccagctgtccccacaatttcgtttcaaatttaatatgccctagaaaatattacatttcaaaatttctagcaatttgcaaaagatagagacagaagaggcagcctctgtagcaaaggcatgtgtaggctctctgcacactgtgggaacacactggaatcctatagtggacatttgttatgtgccccccaaccctctccaggattattctgggtcttctggtacaactccaaaacctcatttagataacacccctcccccattctcagtccatgtagactggatgaggtctccttactccactcaacaaagccaaaaatgaacataagactgctgatgccaacatcagtgctttctactacattatgcttcatattacagtgacatttattgttttgtctgcctaacacaacattcccttcttatggaatggcaactaatggctatgtgatcaagctgcctgggtttgaaacctgttcccaccacttcctacccatgtgacttgatccatttatttaactgctctaagcctccatttcctcatctgtaaaacaaagattcattcacatattcaacaaatatttattgaacacttattatgatccatgcttgtgcaagtgctgagataagaatagtgaataagatagaaaaggtcaatatcctcatggagctcagatatggcagtaaacaacaataaaccaacaagagaggtgcagattataagcgccataaaagaaataaataatgggagaagatagtaaaagagtgattctagatccacttacatagaatgtgcagaatttcaggataaagaggctttcagtataaagcctctctgaggaggtgacattttagctgaaatataaaaagaaagaataagccaaccactcaaagagaactggaagatcattccaggaagagggaaagccagaggaagaaaagagcttggcacaaaaggacatctagataactgaagcatggcaagtgagaagggggtaaaataacacaagacgacatcagaaagctaaacagaagccagactgtgctgagccttgcaggtatgggaagaaattgagatttcattctaggagcgagcaacggaaatccattgaagtgctttatttaaagctttgtgtttttaaaatgttattccagctactatggaaaggatggatatggaaaagaagagtcatctattcaatatagttaagaggatggatggaagagggaaagaaggaaggaatcagggatgatttctaggttacttgggttgagcagctgtgtatatggtgatctattgattgagactacaaagattaggcaaaagtcagggttcaagaattattacatttgagatgcctatcagatcctcaaaatagctgttatacacttttttttttttttttgagacagagtctcactctgtcatccaggctggaatgcagcggcaccatctcggctcattgcaacctccacctcctgggttaaagcaattctcctgtctcagcctcccaagcagctgggactacaggcatgcaccaccacgcccggctaattgttgttgttgttgttgctgttgttgtttttagagacagggttcgccatgttagccaggctggtctcaaactcttgacctcaagtgatccaccctcctcggcctcccaaaatgctgggacatgagccaccatgcccagccctgtgatacatattaaatgaaataatctatgtaaaaagcacaatgcctaatgcagagtaaacattcaataaatgttagctattattcatgttttgagaaaaagaggaaagttccttccttggtctacccatgtggttttggtaatgactgatgactttatcttatcccatgacccagctagggcattggacaactaactggtctagatgaaaccaacaagaatcacactctcttagctgtggtgattggtccatcactcaagccacaccaacttaagttcttccctatgattttcaaactagaagctgaaagggaagttccccttcctcttcagtagggaccctgtaagagtccagggatgctgatggtaaagttcctacttctaggagaaatgccctctgtaattggagggaataaggctgatacccagagagaagcacagatgagagacagagtactagaggcagagagtgcttatttctagtaattctagggtagtgctgtccaatagaagcataatacaagccacatatgaaacactaaaaatagacaggtaaagttaattttaataatacattgtatttaaaccaatgtatccaaaatagtatcatggtaatatgcactcaatatacaaagttgccaaataagaatgatacaatggactttggggactccggaggaaaaatgggagggggggagagggataaaagactatgaatgtggtgcagtgtatactgctcgggcgatgggtgcaccaaaacctcacagatcacactaaagagcttactcatataacctaataccacctgtaccacaataacttatagaaaaattaaaaataaaaaaaaataaaaagttgccaagtgttcaaaacccagtgtgtatggtaaatttgaactcagactagccatatttcaagtgatcaagagcgatatatgactagtggctactgtgttggatagcactaccaacactacctgggctctacccaggccctttgcaggccataagccaatgcatgcccttgtaggatttcattaatttaagttggatttgtgtctcttatcccgagagtccttaatttacctaaaaacattatttcacttattccatttacatctgaaaccctaataattctttttttttttttttagatggattcttgctctgtcacccaggctggagtgcaatggcatgatctcagctcactgcaacctccacctcctggattcaagataatctcctgcctcagcctcccaagtagctgggattacaggcatgtgccaccatgcctcagtaatttttgtatttttagtagaagaggggtttcaccatgttggccatgctggtctcaaatgcctgacctcaggtgatccgcctgcctcagcctcccacactgctgggattacagacatgagccactgtgcccagcctaatcatttttttagaaatcacacacagtacattatattctgaaaattgattcaccaattcttattagcataaggactatcacctatttccctacttgagtgccaactcccacttcacatatgcactacagttaagactcattagacctctgtattccagccttgattagcacaagaaaccataatggagcatctgcaaacaagaatcaaaggtactacaagtgataactctgattgagttgatctgaggtggaatctgggactccatttttttaaatgttgtcctagtaattttgataatcacccagattcaaaactaccgagttggatcacttactaaatctaaatagcaacttctgccccttatttaccttttctattgttacaagtatttcctctgttgtatttactgaagcgcatactatattcacctttgtatacttaattcctaaccccttaatggatatacttcaaatattcaataaatatttgttgaactaaaagaaaaacttaaagtggacttttaatatgatgctatttccaatatgatatctaaaatagtccagagaagtagtgggagataataagagtactaagtttaggtaatggcctatctctccttctttctgttctaattttaattagctctctgctagtctgaattgagggtaaagggagttaattgttggattactctgactacagttacattaaaaagaaagtgccctgtggccatattaagtgccatgttgtacccaaatgtccacctgtagttagataattttgatttaattgacttcactcacatccagagaccatggaagggagtggaagtttggtcaattaaaaatcaagcattaagaatgccaactgattcctcctgagtgagaattagagaaaaggaattctaggtctgtgggcacagggaaagacataccaaagcattcataaatggctcttggttcctcacctccttcttctcttccacacacacattctaggaggttcaataaagtgctgtaatgtgttttgcacacagaaggtactcaacaaagttgtatcagttgctggggccataaccaagtattacaggctgggaggcttaaacaacagaaatttgttttctcacaattctaaaggccagaagtctgagatcaaagcattcgagtggttagttcttgctgaggcctctcaatctggcatgcagatagctgctttcttcctgagtcttcacagggttttccctctgtgtttgtcaatgtcctaatctcctcttcttatagagataccagtcatattggattagagcccaccctaataaccccattttaacttaattacctctttaaagaccctgtctccaaatacagtcacattataaggtagatggggttaggagagcaacatatgaatttaagaagacataattcagcccataacaagtaccgtctaggtaaccactctaacagaggttagatgaatccaagaatagctgaatcttgaagaggtcatatagagttatttggtttcagggatatgttaaacatgaaagatctaaaccagcggtttcaaacactactgttcaacagaatcgattatggggtatgttacaaattatgggtgttctggccacactcagaaattcttaggagtagaccaggcatctgtatgtttgcagcctggaacaaagtctggtattgaccctaaaagacatgtcaacctagacagccagcaatgaggcaagaagcaggactggcaatgaagaggaaaagacctcacgtgaataatgtagtgatctgtatcgctacattctcttcatcattaagtctctgttacccaaaattcactctaataccatattactctctttgtgactttgtccaaacaaagtcttcccaaagacgtaatgcacaatgagaagtctatgcttatgatatttttcagaggagggctggttagaatcacaaatgatgatcatttacttcacacctaatataactcattctccgctgaacggaatttggttgattgactgatttgtttaggccaatggattcaaggaagtgggccatattcatctcatcttcttctcctttaagctgcctctgggacaagttgacacacattttcaccactctctagtctcatggttgattaataatatccgtataattatatttcatcctatcattaaacagtactggattcaaagtaaaactcagtgaaataatttggcacaactgcttttaaaaattatatttttgtattttctccttcatatgcttctttattctatctctgccttccattcaacaaatatttattgtagtgccgggagtatgggaatataacaataaataaaacatagcctctgcccttcagaaaagtaaagtctagaaaagaaaaaaagatgtgtaaacaaataaccacaagagaatgtgccatattataacaaagatacacataaggtcccatggagcacagagtagagaactaacattgcctgaaggcagagcttacacacaaactgaaggatacagtcaagtatccaggcaaggacacaggacaagaacaggcattaaagcaagaaaatgcaaggcaagtttagggaacagaaaatactcatgatggctctaacaaaaggcttgtaaggttgggactcatggtgggccttccatgctacactaaataaccagcactgtcaggggaagtcactgatagttttttaagcaccatcagttctgtgtttaatttcccccaggcataaaattttcctgaggctgtctgctgctccccactccccagcgtgcgcccctcttccacagccccatgccgcctgtgctgtagcaatcagaagtacttactgttctctaaatatgccaggcatgttctcactgactgctaatgtcaaaagcatgacttgaaaaacatctaaatgcatgatcagaccagtgatagcaaccctatggtggagttttcaacagttaataaggggagcaatattgaatcattccagttctctatattttgtcatttgctgttcctgctgcttcatggaaaagggttatattttctctgtaaatagaacttgatatatcttcataaccgtcagcagggatggacactgtgctacttcccagcaaaaggtgaatgaaaagtgatagcagttaaaatggtgttctttgctgtttctctgttttgttttcatactcttcttttaaaatcagactgtaattttaacaaggtggcaggtaaagcattcctttttgcttttaatgctgcctggaaataatttgttttctcctctccagagaaattcttaaaaaaaaaaaaaaaaaaaaaaaaaactgtaaaaacctgactgttctgatacaaaccttgttaataggatgttcaccttaaaactaacccaaaagaggaacaagtaaagcaacatgataacaaatcacagaattttagaaaggactaagagcaaatgtagtggtgtggttaaaagctatggttcctttgaagctcaaattaagaagaacctgctagtactgatcatctagcatcctaagtgggaacatagcaaatagacatagaattataaccctaagagttgaaatcagaataatagcaccaatgaactcctcaaatcattttttaaaggaatatatttgtgaggcaatgcaagtgaaaattacataatatacagttactaaattcctgagagttctatttttgtttattcaatatctactaatataaggacaaaaatcattgctaatgatcaaaagagcatagcaatcattatcaaattaagaggccaggcatggtggctcatacctgtaatcccagcaatttgggaggctgaggctggcagatcgcttgagctcaaaagttggagaccagccagggcaacatagtaaaacccatctctacaaaaaaatataaaaattagccaggcgtggtgatgtgcacccattgtcccagctacttgagagtctgaggtgagagaatcacccaagcccggggaagtcaaggctgaagtgaaccatgatcacgccactgcactccagcctgagcgacagaaagaaaccctctccaaaagaaaagaaagaaaaattaattaagatgtgattcaatacattttttccaattctttaagttattaagaagccaatgtcaatctctcatccactgcaggaatctcctagtttccctaatatacaacttcggtctctgctgaaatattaccttttttatcgtaaatacttaaggtatacaacatgatgttttgttatacatatacatagtgaaatcattatcacagtcaaacaaattaacatatctgtcatctcagataccttttttccccctttggtgataatctactctcttagcaaatttctagtatacgatgtgatatcattctgtacattggatctctagacatgctgtacattggatctctagacattcatgctacataattacaactttgtaccttttgacatacatctccccattcctgtccctccctccccaccccaggccctagtaaccaccattctactctgtgtctatatattcaactttttttttagattctgcacataagtgagatcatgcagtgtttttctttctgtgcctggctttttcactcaggatactgtcctccaggtttatccatgttctctcaaatagcaagatctccttttttaaggctggacaatattccatcgtgtgtgtgtgtgtgtgtgtgtgtgtgtgtgtgtgtgtgtgtgtgtgtgtaccaccatttctctatccattcatccatcaacaaatgcctaggttgtttccattctggaccatggtagatactgctgcaataaacatgggagctcagatatcttgacaaggtgctgacttcatttccgttggatacatacccacaagagggactgattgctgagttatattgtagtcttatttttaattttttgaggaacctccactcagttttccatagtggctgcactaatttacatacaaaagtttcctttcctccacagtctcaccaacacatctctttttggtttatttctgaactctctattttattccatctgtctatgtgtctgtttttatgccagtaccatactatttttccatattataactttgtaatatagtttgaaatcaggaagtgtgatgcctcaaactttgtttttctttctcaagattgctttgcctatttggggtcttttatgtttccatacaaatattttctatttctgtaaaatattacctttgcctcttcttttcctttcttcccatgtcatagttccctttctttttcttccctcttctctctatgcttctcattctagatcacatttgggtaatgttaggtacatgtatatagtgactatttctcctggaagatgatttagactacaactacaactataatcacttagaaaagtgtagaattcctctgtccacctagaatagagctgaatttgttcatattccattccaaacacagcattctaggaaactatgaagtattctgcaagctgtaaaaagatccatataatagaatattatttgccattaaaaaggaataaagggccagacgtggtggctcacgcctgtaatcccagcactttgggaggctgaggtcaggagttcaagaacagcctggccaacatggggaaaccccttctctactaaaaatacaaaaattagctgggcatggtgccccgtgcctgtaatcccagctacttgggaagctgaggcaggagaactgcttgaaccagggaggcggaggtcgcagtgagccgagatcgcaccactgcattccagcctgggctacagggcaagactccatctcaaaaaaaaaaaaaaaaaaaaaaagaggaataaagtacagatacatgcaataacatgggtgaattctgaaaacatgctaagtgaaagaagacagtcatataggccacacattgtatgattccacttatatgaattgtacagaataggcaaatctattgaaacagaaagtagattagtaattgtctacactggggagatgggaggaatgggaagtgactgctaataagtacagtggcttctttttagagcgatgaacatattctaaaattagactgtggtagtggtttcacaactctgttaatatattaaaaaccatccaattaaaaactttaaataggtgaacattatgagaattatatctcaataaagctgtttaaaaacatgtatctaacgcaacagtctatgtgtacacacccataatatatgcatatatatacatactcatttacagagagttctgaattatcagcctgcagtttatccactgaaattttaaaattcaaaatttcttacttccttgattgtatgagaatggtaataataacaataatgacagcaataataatatcaagtactcatttagttcatactatgtgccagctattgtgctaaaaatacgtaatcttattaaaaccttacaaagtcaccaaataatagagtctgttactaaccattttaacatattattttttataatcctcacaacaagaactacagtttttctcaatttatgagaaaactgagatttagggtggtgaaataaatcattctcggttttacagctagtagttggcagagcaatgatttaaactccggtcactgcactctgctgccacttgagctatccctctgtaagggcaattgagtctcagtgagctaaaagaatcttacattacttttgcagacaggcatctaacagagtaggaaaaatcccagaaccaaaagctgaaacccagaccgcagtctgagtcatgatacaaactaaccaggccagccaaattccaatcctctcatctacaaacatggaaattggaatagaaatttttcaaggtcctatcagcttaaaagtccatttgtccaagaaaaacttacttaaaaatctgagtcttcagtccaaaataaacttgccagaagaaatgctttctttattttctgccctatgagtttacgactattattaggttgtaaaaatattaagtataactggaaactgaaagcataattaacatttacttataaagttcgatatcacccattagcaatataacacataatgatttattaactttttactataaaaacttttaaacatattcaaaagtagacagaatagtattaaaaaacccaacgtactcatcatacacctttaaaaatcgtcaactcatggtcaaatttgttccatctatataccctcccactttgaagaaaatccatggcatcataacatttctgtaaatatttcagtatccatgtgtaaaagataagggttcccttcttaaaagtataatcatgataccatcatgacacctaaaaatattaacaataatatcttaatatgacaaacttggaaaatacatttagatatataaatggcaataaataatacagatttaagtaccactttcactgatattaaaagataaacctaggcacattaaaattttaaagagtttatttgagcattcagtgattcatgaattaggcagcaccagactgcaagtgatttgggctccaccaaaggcgtgcaagggaaaacttttataaggtgtctgtggaagcaggacagagaaaatgtttgatttattaaagtggagagtccctacttagaggtaattggcagtgtctggtaaagactctagatagagattcactggtgctttctgatttgttaaacttaagtttcatttcactgttttacagtgtgtttactgtttacagtgagtttggtttcagtttgcttacataggaacccaaagcactacctaatggtttcccaatcaatttttttttttttttgagacagagtctcactctgttgcccaggctggagtgcagtggcataatctccactcactgcaacctctgcctcccgggttcaagtgattctcatgcctcagcctcccaagtagctgggattacaggcacacaccaccacgcctggctaatttttatatttttagtagagacagggtttcaccgtgttggccaggctggtctggaactcccggccttaagcaatctgcccgtttcagcctcccaaagtactgggattacaggcgtgagccactgcacctggccccagttaatttttttaacactgacaaattttactttgagtgttaaggctatctgtatattcaaattttccagactattatttctatttgaatacattatttatatatataatctattatatctatacctaatgtctctgtactctattcatgaaatgtcatatggcactatactgaatgtgtccatagaagtagagtactaaacattctatatatactgagcttattagttttgtttactcattgagcttgcctggtattgaaaagaaattaaattagttaggcatggtttgtttgtgattaacctttcctgtcttccacagttcaatttatcatcctcttcgtgataccaaatgactactttatgaattgttccacaaatttgccagctattattcacgagctacatattttatccaactgaagtgtttattctgtgacccttattttcatataactctctataaccattttgcttctaccatacttactctcacattccttccctagcttgccttgccctccaaaacaaaaaagcttccaccatgaaattactaattgatattctgccttataaactttgccttgaaagattcctttgaaaaattaatttcatttcctcgatctagccaatgataaaataatgatgacagcaaacagaagtagaaacagcataattttttaaaaaaggaaacatcaaattttgtattgaaaatttacatcagcatttcactagtgaacagacatttcctctgagaaagagtgataattaccatttgcacctcatgtaaggattttcctgaggcctaagaaagctataaataatatagtttcttttgaaataaagaaaaaaaatttaattttctttcatcacgctaacaagaagtaaaataggttgcaaataatggtgtagtaaatggattaaagagattagcttcaaaataactgcactgcaggacctaaatgctgaacttgggttatccaggctaaataaaggccagtcatcatcttatttttatagttcaatcataagttagggcttatgggagtaacgcaattaagaaaatatatatatttgggggagttggaaaagtttggaaaatttcaaaaatcaaatcacatttcaaatggattaggagaactcactaattaaaggtggatagatttcatactgttaaaaaaaaaactcaaacaagtaaaaaaaaatttatgattaaccaccaatacaaacaataggcaaatttattagtttctctgctcttgctttacaactgtaacctttataacaaaccctgttagaccttgtaggagaccctgttaatgcccacaccatatccccctgacttgtctgtgagttctcttccactgctgtggatagtcatgctgatgctgacagcttcccacctaaaggacccacagttctttctccattttctctttattcttcctggaaccaccttgcacatacactacccatgcctaagtccttacaccagggtctgcttttggggaaaaccctaataagactgttggtaatagaaatagcactagaaagcagaccttcagaatgagattctggaattgcattacttgctggtcagagggcagcaaggatccaatttctagtgataagtgagtggtgataacccctaacaggctacagcagtataatgcccaaaatttttaactgaggtggactgtaatgtgttacaggaaggaggaagtacaagcttatataatagctctaatacttgaaagacatgtggtaatcaaaacaaagattttggagtatgtgttaactactcgagaagctttgaagaatgagaatggcaggcttgggtaagccatctatcaattcagggcatgctgtaaaagtcagaaaaactccatgtcagtatttaaaatgaaccttatctctggcactcagctaacatactatactgaaatcaggcctaagatttgatgaaggagcttagctacaaagacaactaaatgcacagccccagcaggtctcccatcagggctctgatagggaaagggggagggtggtgatgcatgggagggtgatatttaggggggtgtacatgagaccactaaacactcaaatctgctgaaacctctgggccggcagaatccaccctcatccctttcataaaggtaagccacctctaattgcatggagacctggcaaaggacatacctgacgggggtgccttcctccagatctgcccttcatctttcattgcctctagaccagtaactagggtcaggtcctactgataaaagctccaactgtaaggcgcagtggctcacacctgtaatcccagcactttggtaggctgaggcgggtggatcacctgagatcaggagttcaagaccaacttgaccaacatggtgaaacctcatctctactaaaaatacaaaattatctgggcatggtgatgcatgcctgtaatcctagctacttgggaggctgaggcaagagaatcacttgaactcgcgaggcggaggttgcagtgagctgaggtcgcaccattgcactccagcatgggcaacaagaacaaaaagctgtctcaaaaaaaaaaaaaaaaaagctccaactgtgaagggcacaccttcacattggtgggaagaatatgggaagaaatcacctattcaccgaaaaagtcagctgagcctatctgacatgtgtcattagaactgagagcacacataaggacgtggatgttgagggtgctgagctgaggcatggggaaagaatgctagatagaggagagtgctttcatatggaggcaatctctggtgattcataatttaatttgtagcaaggaaatcataagtaggtcctaaaacactaatgggatgtcaatgtgactgacaggattccaaaataacaggcatcagaggtggcacttagccatcagaagcaaggtgaatgcacgccattaaaggtagtaaggtcagagcagtaaccagagagcttgacctgcaggggtctgtggcaatggttgataagtcattagccattttgtttatagaagcaaaagagatgggtaatgtatttgttgctagggctgctgtcacgaactaagtgacttaaacaagagaaatttaccgtctcacagttttgaaggccagaagtccaagatcaagacattgttggttccttttaagggctgggtgaatctgttccatgactctctcctatcttctggtggttttctggcattctgttgcgttcattaacttatagaagcatcaccccaatctctgccttcatcttcacatgacattctccttgtgtacatttctgtgtcaatattttctttttgataagaataccagccacattggattaggggcacaacctaccccagtatgatctcatggttactcattacacaattcaacctatgacaagtagttaataaggttaattttttatttatatttgcaaagaagaccaagaactaaacagaagatcgatgttccttttctggatctaaggcagttctcagacccagagcccatcaaggggaggctaagtcctcttgagcgaaagagctaatgtttctccaataattctttaaggggaagtgctgccatataacagagtatatggcaccatatgccagtatatacactggtgaaagtggaatacccaaacctttcagggctattggatataggctctaagctgacacttataccagggtatccaaaatagctttgtggtctcccagttagagtaagagcatttggaagccagataataaatggagccctgactcaagtccatctcaccatcagcccaatgggtctccagacccaccaactggtcacgtacctggtccctgagtacataattgagatggatatacttagaagcagctagaatccaaacactggttctctgaactatgaaacaagagccattataatagaaagggacaaagaaagcccctggtatcacttctgctctgtccctggcccaaataataaatcagaaagaatattttggccaggtggaataacaatttgtgccaccctcagaatgcttcctgcaaaaaaaccatacggctcatggatgagtcagctaaatacgttggtgcaagaggaaaactactgtcacactatagcccaaggcaaggatgaactactgcaatgttactcaaagtgtaatccatagactagtgccaattcataaatttatttttgtaagtcgacaaaataattattaaaagtgagagtacatatttggaaacattagagcaatttgacattgctgtaataactgtagttttatattttacaaaaagatcactcatgttgaactgaaaacaaacccatatatagttccttcacatgatcagtttgagtagcactgttctaaaggacagtggtgaaaggaaatccatcaggcagagcttcataactttacatgaagaaagaagtggtttgaggtgagaacaatatcaattgttgggcaggggctagtggttctgctaattgatcagatgcctggaagaagcaatacttcatgatcagatacaaggaggtctgagaaggaggcatgtggatgaccctataggtgtgaatacctaacaaagcatctatagtagaggcagcattgaacaaccagatggaaaagatgacccatccaatgaatgtcagccaatctttgtcctcagccatcacaatggttgcacagtggacatggaaactgactagccataatgtcagggatggaggctatgcatgggcataaaagcatatactccctctcaccaagggtaatctagctattgacagtgctgaatgtctgaccaataagtactggcccaaagtggcccctcaatacagaaccatccctcaaaaaagccaatcagacatttgtggcaggttgattacatcaaattcctttccaccttggaaggcacagcaattcatcctcaatgggcctgatggttattcaaacatgcttttgccttttttgcctctgccaggtcatatttactagcataggatccaccagtctcaccttttatggccattctagcactccatcaagctgatgaaccactagcattccatcaagctgatggccaaaaggctcagctttagaataactgtctaaaggattggtgccccatcctcttaaacagaggtccccaatctccagcctgcagagaggtaactctccatggcctgtgaggaaccaggctgcacagcaggaggtgagcagcaaggaagcaagcattatcgcctgagcgctgtctcttgacagatcaggagtggcattagattctcataggaggtgaactctactgtgaactatgcatgcaagggctctaggttgcatgctccttatgagaatctaatgcctaaggcagaacaatttcatcctgaaaccaaccactctccccatcccagcctcccacctctgtccatggaaaaattgacttccacaaaagcagtctctggtgccaaaaaggttggaactgctgctctacagcgcagtagatgagtcaaaccaatgatcattacacgatgttctgtccccttagcatgggtgtgggaactaaggggtagaagtagaattggcagcactcaccacttaacccacttgggaaatttgtccatcctcagtagccaagttgggtaatttgtacttcccgttctctcaacttcagactctgtgggatgtgataccttaacccctatgagtggaacactttcaccagagagtaaattactttcacccaaaccctttattttggtgcctgatttaaaagagaatctgagttaactttaacacagttagatacaattattatcaccttatattgaggaatgaggcacgaggaagtttaagtggaccagggtcacacagctagtaagtgatagaatcagaacttgaccctgggcagtctcatctagagtccttgctttcaacctctactctaaattatctgtttttaaagttcatgtttttgtatttagttgtcttggagcaaagcattcctatattattttatgtttctaaggcaggtgtggctagcacctctataattaaaataaagttcaattaaatctgaacaagtattatttaatatagttttttattattttaatacaggtttcaatgtaatcagacagtaacaatgtctagctctgtcttcatttagcatgtatctataaacacgctccttaaaaacatacctaaacacacacacaaaaaaagatgtctttataacaaattttcacaagttatgcatttttgaacaacagttaacaggataagttcaaggtaacagttgccagtgattttcatccctaggaagtaggtaaatcaaccaggctaggagttttcaaaaataaacataaactcctttgtactagctaatccttatcatttagcatcacctgtccttcagctggccctatgcttgaggcatcagaatgaagccctgggaactagtattcaaatcacaattattttaaagtttacaatgggcaatttcctaaaagtgatatgatagaaagagtatgaattctggagtcagacaatcccagttttgcaacttacctgctatgtggcctaggacaagttatttaacttttggatcttcagttttccaatatatagaatgtggaagaaaaaaagattgaagtatgcaaagtgcctagtgtaccatctagcatccagcagctacttaataagtaatagtttccttcttcataggtattattaattaattcatgtttacataattacttgcaactaaaataaacaataaataatgtagaaaatcctaagggtcttataagtttagatggaaataaattggaagcttgcataaacagattaaaacacagattcacaagaagaggaaataacaataatagattagaaagcaggtagacccagccataggaaagaaaacttaaatactactcagcaatatctccaggataccatcagaactgttttggtcaccccataggggtagacatggatatccactgctataattttgcactgtactaacatggtagcctctagccacaggtggcaaattgagcacttgaaatatagctagcccaaattgaaatgtgctgcagagttaaaaaaaaaaaaaaacctggatttcaaaaacttggcatgaaaaaatatataaaatatctcattaaaaatgtttagattgattacatattgaaataatatttggatttattgtgttaaagaaaacattgttagatttaacttcatttccctctttttactttctttatggtggccactagaaattttaaatttacataagtggtttgcattttatttccactggacagcactaatgtgaggtcctaatttaacttgaacagcactgatgtagagtcctcattcttaggctcccatgttcttccctcccagtcttccattctttagcaaagacttagcactacagtaacaacaattttcattcatgtccctgtatgagggccccactatcctggatgcaacacacggatgatttgccacaaatagtctttaaatgatttataaaatatataggaatgaataagcggataaataactcccagcgaaaaatgtccctcaaggacaatattcacataggcaagactctgtggtactttctaacacactttaaaaggaacattattttaatatgcactatccattcacgacattcaagacaagtgaaggttagctgtctactagaaaaaataaaattttaaacttgaggcatttattcatataatcaagagtctaggaaaactgcctgaattagtcaaggttctccagaggacaaaaaaaaaaatgcatatatacatatatggagatttattggagaactgactcacaagattatggagactgaaaagtccaccaatgattaattcattcattcatactttacatagtttaaaagtccctggcatcaagcagggtacccaggaaagccggtggtgcgattcagaccaaatctaaaggcctgagaactagggaggctgctggtgtaaatctcagagtccaaaggagttcaaaggcctaaaggaggcgctccatgtccaaaggcaggagaagatgtcccagctcaagaacagaacaaatttgcccttcctccactttcttgttctattcaggccctcgaagccagactgaatgacactcacccacatgggtgaggacaatcttctttactcagtcaactaagtcacatgttaatctcttccagaaacacactcaacagacagacctagaaataatgttttaccacttatctggtcattctttagtccagtcaagtttgacacataaaattagccatcacaccacctcaatcctctacacaaatttggctgaaactagcttgataagtctttctatcagaggcttcagtggaaaaactgaccaggtgatatggtttggctctgcatccccacccaaatctcatctcaaattgtaatccccatgtgtcgaggaaggacctgtaatccccatctgtcaacagaggaaggtgattggatcatgggggtggtttcccccatgctgttctcatgatagtgagtgagttctcatgagatctgatgcttttataaggggctcttccccctttgctttctctgtctctcctgccgccttgtgaagaaggtgcctgcttccccttccatcatgactgtaagtttcttgaggcctctccagccatgcagaactgtgagtcaattaaacgtcttccttttataaattacccagtctcagggaagttatttacagcagtgtgaaaatggattaatataccaggcaactccacagactctgggtatcttcttcaagtgtttcacaaatacagtttcccaatctttacagaacatgagactccaaaaataaccaaattctcacttcccctgctcacactccccccaaaaaatctactcaccacaaacaaagcaatctaatctgatagtagaaaaatcaaaattaatgaacagaaaaaaatctgttttggagataaaaaccagagaaccactggagaagatgacataaacagtgaaagatcacaggatggcttttcatcttcataactctgccattagtaaacaacacacactaatattttgcttctatgaaaatctcctgtataaattttcaaggaaaaattagtaatataaaaatatgaaaaatataaacttttttttttacttcgaaagtttttaatctcttagacaagtataattacagcaagcacttttctacaagtaactttaagctaatggacatataatggataacaataagcatcctagagtcaagttacctgggttcaagtgccagctctgccacttaggtgctgtgtgaccttgagaaaatcccttaacctttccctgctcagtttcctcctctataaaatgtggataatagcagctacctgagggagttgttataattaaatacattaacatataaagcatttaaaacagtgcctgacacatagcaaaatctaaataagtggtacttattattacaaatgaccaaaaattaagtgacagtaattggtacatctaatctcacctaaatgtcttttcatttaattgatgactgttctcctcactaaggacttctttaattcttccaacaggtgataaattgttactaggtttaagagccaaaggatacatattaaattttttgcaagactcaataaatatggttttatagcactaaacacttctaacaagagtaggaaaaaaaacatttcaggaaaaacgttttgtattaagaataggaaagtcaacagattgataccattaataccaatggacataatacttaaggcccaaaccacaccatattccactagcatttactaagtgtcaattgtgtgactggtgtttccaagatactggacatacaaagaagacaaggactctatccttaagggctcagggtgagtatacaggcaatacacaattatgttatgatgtaaactatggtttgaatgtgtcccccgaagttcatgtgttgggaacttaatccccaatgcaatagtgttgagaggtgagaaattcaagaggtgattagggtatgaaggctctgcccttctgaatggattaatgacattaaggtaggaatgggttactcataaaaagaataagttcagcccctcttaccccttttaacttccaccatgagataacacagcatgaaggccctcaccagatgccaccccttgaccttggacctctcagcctccagaactataaaaaaaaaaaaattcttttccttataaattacttaatctgtggcattctgctatagcaacatgaaatggactaagacaatgtattataacagaagtatgagcaaagtgcattacaggcaaaagaagaaatctgaacaaagccaaagaagcatgaaactgcatagcatatttggggaatggtaactcacctaatatggcttcagcattccatcaagaccttacattgctcttgttttttcaaacattaactacctgtcatgtgcaaggcaccaaagaaacagacatgtaatccatagcctctgggaaggtaatatctgtttcaggtgctaatgtataaatagaagttagctgcaagaacaaaggagtaagagcattctaggaaggagaaatggcatatgcaaaggcattctgagaaccaggaagagtttaacaagtctaaatccacgggaggatcccaagataaaggcagaggtgggatcattagatgttttggatgccaggcttttataacaaaagtgactagtaatcactaaaggatttaaaataagatcatgaccagatctgtgttttaacaaagcccttctgatagaaggccagtaaggagtaatccaggaggtaaaagggataaggaaatagcattagtgatggtgacagaaaaaaaggaaagaacatattcaagagggtcttcgatgagaaaatttggtaaaagtaaggaagaaggagattccttggatggtgccttgagttttttcctaatccctctatccccctagtagaaacatcttctcctttgaacctattttatttctacgttagtggacttttaggggggtacctatttattcatgtctccctcctcctactggtaaactcattatgggcagagactgtgccttatcccccttatattcttagcaggaccagaactagggtgaggagagtgaggcattcaacttcaggttcatgctggtacaaggttgaaatctgtttctatttaaaattttcatattttgttcatcacagactttttgcatacattttgattttttaaacattaaattaaaatattgtatattatttaatactttggcacactcttaaattttatacctgtggcaagtacctcacttacccctagtcaaagacctgatactcagtgtcttcctgacatagtacctaacacaagcaggtacttaaatgcatgttgaatgaaggaaaagcaaacaagtggcataagcaacaagatggatggtggtgggccttttacagagacagtgaatacaggaagagcaaaagactctagaggaacatgagtttataatgcatgtcagaagcactgcttggtgtattacagattaatttattattcaacactggaagcatgtataatggaaatattaaaggatgacattactcaaggaattgttctcaagatatttccccattctctttttaaaacttacactaatatttgaggtattgcagcaatatctaatttcttagttcagcttttaagttaacatttcttaggatgccaagatgagatgcttgttacatatatgtaccattaacactgctatggtatgaatgtttgtgttcccccaaaattcatatgttgaaatcctaatccccaagataatggtattaagaggtggaaccttttgggaagtaatcatgtcatgacagcaaagccctcacgaatggcattagcacctttattataaaggcccccgaaaaatgacttgcatcttccactatttgaggacacagctagaaagcaccatttaagaatcagagagagggccctaccagacacttcccaatctccagaagtctgagaaatgaattgtttataagccactcagtcaatggtatcttattatagctgcccaaatagactaaagacaaacacagtctttgatatgacttcatcaaacggcacccacatcactctatttctgtatccttgctcacttttcttcatagcatttatcactactagatgcagtataagttagttatttttcttccccctttaaaaaagattcactccatgagaacacagaatttttctgttttgttcatagttgtatccccagcacctagaataaatgccattgaaggtcatgacaaagagtgcgagggtggctgggggctggcttacactggagcagaaataagacaaaaaaaataaattaaaccctctgtggatacaaaactagagctaggcgctcacaagaatttaacagaaagccctaggagccaaaaacaaagatgcaattgcaaaccagagcaataagcttgggagcttacctgtagtcaccttgggaagtaaccagtgggcttgggtttaatagcctttggccagatgagattcaaatctctggataaagctgataccctcaaaggattacatacttggctatcactggcataccagaagataaaaggaaacttgcatttctcagcctgggctccgggaagaataaaaaagtctccctgagaattcttaaatatgacctagcctcctatctttggggctttaaatttataccacccagatggtcttggactcccaagccaagaaagtatatagtggttctgggtgtgatagttatcaatgtattttctcacagctcccaatgcacccttctttgtcttgctttatatattggagctggaccctacgagcattttcctttgacttctggctcaatgttaagcttcgtcaaaaggagggacaaggctgatcagcccattgaaaaaaaggtaagtgattccaaacaaactagttttacttattaaatataataaaacataaaatatttgtttctgaaaacctaacagaaagttaatacatagaattgtcatccaatatgaacatttccaatggtagggctggccttaagtcaagcttaatttttcatatactgaaacattacccatctaacatttgaacagattttttatctgattctcatctaactcaatagctgttatctttgaagatttatagcctcacacctaaatggatagcttttaagtagttttttaggccagtgggccccagattcatttatcataagattggttgcctatatatcccatttcacattccaaatatcttcccattttatagaatgataaagggttatatgcattttggatatagtaagaatgaaaatcattgagaaaaacctgggttgccaatttatatatttaatgcttatcagttaaactttaacttgctctatagtaactttaacttgcttatattaggactgcaaagtacaaaacatactccaacccagattctagcaagtaccaccttgcgaaggttaattttatctgtcaatttaaggtccccagatacttagtcaaacattatttggtgaaggtgtttaaatcggtagactgagtaaagcaggctgccctccctaacatggtaagcctcatccaattagttgaaagtctggatagaacaaaaaagttgaccttctcttgaataagaaaaaattcttccagcccaactgcctttaaaatgggatatcagttttttcctgccttctgacttgaactgaaacatcagctcttcctgggtctcaggcctgctggtcttcagaatggaaccacatcgctggctctcctggatctccagcttgcagatcttgcatcctgcaggtcttggaacttgtcagcctccataatcacacaagccaattccttataataaatgcctttatatacatatgcacatatcctattggctctgtttctctggagaaccctaatacacactgcaaatgacctcttattaactcctgctaaagcatcccgcctaaatagctacaaatgttccagacctttccctttctcctctcatttcaaaaggtaaaagtattgtgtttactatcttgtcttctcattgtccccattcccccatgctactaccttgtggaaacacattcctaccccacctctgtaattctgtggttagaacatgagctttgaaatcctgcctaccctctggattacagttgtttggctggatatcctccaagctgagccaatcagaagccataaatgtaaattagatttttgaaatttgtatttagaaactgaaagagagttgattgaagtccctctctgccaacaaccatgtgtgggagttaggcctaagaaaatgaaggagacacactgaaacagaggtaaaagctgaaagaaaaaaaaatagcatcctactgatacctaattccctcatttatacctgaagcttagcctcaccctgtctttccctgacccctttacagtagtcaataaattcccttttggcctaaactggtttgaattaggtttcagtcagtcacaactagagaagacacagtaaattcctactgcatgtaaatcattacagaaatctgtgaattatattaaaaataaccaaacttagttattcaaatgttttctaaaatctgtttgccataaattgatattattcaaaaatatatatatgttccatatttgtcctagaaacattaacattgaagctacttaaaatgcaaagattgcctaggaagaatgtctctttgcttgtttttacaagggacttatcaaattagaaagcaaaattagaaatcataatgagttccatgttctctggtgaacactatgaggtaccattaaaaatgttatataaaccaggagcagcggctcacacctgtaataccagcactttgggaagctaaggcaggaggatcacttgggcccaggagtttgagactgcagtgacttatgatggcaccactgcactctagcctgggcaacacagtgataccccatctctttaaaagaaaaaaaagaagaagaaacaagaatatgctgctttaagtttgtactatttttataaattaattttaattttaaaaaacactttaactgctatataaaaataatactataactaaaaatattgtaatctgaatctttaaggaaaaccatacaaatttactaaatgaggttatcattaccaaatatcttcttggcacttttaagttttaaattgagtgttttcttagctggttgaaggctgaaattcattatcttcttatagaactcttgttatatagaaaacacttaattatgaagtagttattcatacacatgaaagataaactggtcctgaatttcctcctcaataatataaatgttatcctaagaaacaggaaaaaaatggtggcttgggtaattaaaattcagagataaacacaatcttcagtacccaaattcaattgaattcaaagtcttcaaccacctattattttattttattttattttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggcctcacctattattttataaagctgctgacaaatattaaagttttaatagttgttttctctaatttgattgcccttatagattttcctgaatgatgtgctaagtagcataattgtgaataagcagaaagtaagagagaatataaaaagctaacacacatatacacttcaaaaacaaacttgatgagaacttagtcacaaagggtataaaccctctcaggatcgtaactccaggtgacttttctttttcactcttactaattttaccaactacgaaagggaatcagataatcctagaataggtaagagaggaaaagcaggcttggaagtgatcaacagactctatataaggccactaaaggaactagggagtgataagtaaactagttagtagaagtattaataaaaatttcaggccccagaatcatgctcacagattggaaaggttagatttttctgttgctttaatattatacaattgcaggaaatattataagcttcatttgtccaacagcatcatgagaacaggtaatgaatacaatatttcaggttcagctcacagaactaattttcataaattcttatataagtgaaaaacctcttatcctattgcaatgttctcaatctcattgccattaagactcttcacacaataaccactcagttaagagaatgacagagggattttttttcatgtgttttttggctgcataaatgtcttcttttgagaagtgtctgttcatatccttcgcccacttgttgatggggtggtttgttttgttcttgtaaatttgtttgagttcattgtagattctggatattagccctttgtcagatgagtaggttgcaaaaattttctcccattctgtaggttgcctgttcactctgatggtagtttcttttgctgtgcagaagctttttagtttaattaggtcccatttgtcaattttggcttttgttgccattgcttttggtgttttagacatgaagtccttgcccatgcctatgttctgaatggtattgcctaggttttcttctagggtttttatggttttaggtctaacatttaagtctttaatccatcttgaattaatttttgtataaggtgtaaggaagggatccagtttcagccttctacatgtggctagccagttttcccaacaccatttattaaaaagggaatcctttccccattgcttgtttttctcaggtttgtcaaagatcagatagttgcagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcaggctcttttttggttccacatgaactttaaagtagttttttccaattctgtgaagaaagtcattggtagcttgatggggatggcattgaatctataaattacctggggccgtatggccattttcacaatattgattcttcctacccatgagcatggaatgttcttccatttgtttgtatcctcttttatttcgttgagcagtggtttgtagttctccttgaagaagtccttcacatcccttgtaagttggattcctaggtattttattctctttgaagcaattgtgaatgggagttcactcatgatttggctctctgtttgtctgttattggtgtataagaatgcttgtgatttttgtacattgattttgtatactgagactttgctgaagttgcttatcagcttgaggagattttgggctgagacaatggggttttctagatatacaatcatgtcatctgcaaacagggacaatttgacttcttcttttcctaatcgaatatcctctatttccttctcctgcctgattgccctggccagaacttccaacactatgttgaacaggagtggtgagagagggcatccctgtcttgtgcccgttttcaaagggaatgcttcatcatcactggccatcagagaaatgcaaatcaaaaccacaatgagataccatctcacaccagttagaatggcgatcattaaaaagtcaggaaacaacaggtgccggaaaggatgtggagaaataggaatacttttacactgttggtgggactgtaaactagttcaaccattgtggaagtcagtgtggtgattcctcagggatctagaactagaagtaccatttgacccagccatcccattactgggtatatacccaaaggattacaaatcatgctgctataaagacacatgcgaaggtatgtttatagcggcactattcacaatagcaaagacttggaaccaacccaaatgtccaacaatgatagactggattaagaaaatgtggcacacatacaccatggaatactatgcagccataaaaatgatgagttcatgtcctttgtagggacatggatgaaactggaaaccatcattctcagcaaactatcacaaggacaaaaaaccgaacactgcatgttctcactcataggtggaattgaacaatgagaacacacggacacaggaaggggaacatcacacaccagggactgttgtggggtcgggggagaggggagggatagcattaggagatatacctaatgctaaatgatgagttaatggttgcagcacaccaacgtggcacatgtatacatatgtaacaaacctgcacgttgtgcacatgtaccctaaaacttaaagtataataataataaaatttaaaaaaaaagagaatgacagagggattaccaaaacagaaagggtacacatgctgatagtaatatccaattcacaaatattcctctacgcagttctaacccaggaaatatgtcttgtaattatgaaactttgatattttctgctatatagaagcattcattctaaacagtgaaatattctaaaaagttttgagtctatattaaggagaacattttaattaatgtgtctatcaaaataaaattagagttaatataagcaacatcaatgaaaggtttgtggaaaagaatgttttatttttatgggtacatagtgtatgtatttatggggtacatgagaaattttgatacagaaatacagtgtgtaataatcacatcagggtaaacagggtatccatcacctcaagcatttatttctttgtgttacaaacattccaattatactctagttattttaaaatatataataaattaatgttgactgtagtcaccctgttgtgctatcaaatgctaggtcttattcattccctctaattatatttttgtacccattaaccatccccactgccctactccccttcccagcctctggtaaccatcatcctactctcttatattcatgagttcaattgttttcatttttagcttcagcaaatgagtgagaacatgcaaagtttctctttctgtgcctggcttatttcacttgacataacgtcttccaattccatccatgttgttgcaaattacaggatctcattatttacaattgaataatactacattgtgtatacgtgacacattttcttcatctatttgtctgttgatggacacttaggttgattccaaattttggctattgggaatagtgctgcaataaacatgggggtgtaaatatgtctttgatatattgatttcttttcttttgggcatatacttagcaatgggattgctggatcatatggtatttctctatatttctagttgtttgaggaacctccatactgttctccatagtggctctactaatttacattcccaccaacagcatacaaatgttcccttttctccacatcttctacagcattcattattgcctgtcttttggaggtaagccattgtaactggggtgaaatgatatctccttgtagttttgatttgcatttctctgatgatcagtgatgttgaacatcttttcatatgcctgtctgccatttgtatgtcttcttttgataaatgtcttttcaaatattttgccaatattttaattgaattactagatttttttcccatagagttgtttgagctccttatatattctggttattaatcccttgtcagatggatagtttgcaaatattttctctcattctgtggattgtctcttcattgtttcctttactgtgcagaagctttttaacttgatgtgatcccatttgtccatgtttgctttggttgcctgtgcttgtgaggtattactcaagaaatctttgcccagtccaatgtcctgaagagtttctacaaaattttcttgtaccaatttcatagtctggggtcttaaagtctttaatccattctgatttgatttttttagatggcaagagataggggtccagtttcattcttgtgcatatggatatcaagttttcccagcaccatttactgaagagactgtctttttccccaatgtacgttctggcacctttgtcaaaaatgagttcactgtaggtgtgtggatttgtttctgggttctctattctgttccattggtctgtgtctgtttttatgccagtactgtgctgtgttggtcactatagctctgtagtataatttgaattcagataatgtgattcctccggttttgttcattttgcttgggatggctttgtctattttgggtcctttgtggttccatataaattttaggattattttttatgtttctgtgaagaatatcactggtattttgatagggattacattgaatctgtagactgctttgggtagtatggacattttgacaatagtgattcttccaatccatgaacatgaaatatttttccatttttccatgtcctcttcaatttcttgcatcagtgttgtatagttttcactgtagaaatctttcacatctttggttaagtttattcctgggtatttttttatgagattactttcttgatttctttttaagactgttcaccctggcatatagaacactactgattttttatgttggttttgtattctgcaactttactgaatgtgtttatcagttctaatagttttttggtgggggcttcaggtttttctaaatataagactatatcatctgcaaacaaggataatttgacttcttcctttccattttggatgctctttctttctttctcttgtctgattgcttagctgggacttgcagtaccatgttgaataacagtagtgaaaggaagcatctttgtcttgttctagattttatgggaaaggttttccatttttccccattcagtaagatactagctgtgggtctgttgtatattgcttttactgtgttcaagtatgttccttctattccaagtgttttgagggttttatcatgaagggatgttgaattttatcaaatgttttttcagtatcaaatgaaatgatcatatagtttttctcagtatctaatgaaatgatcatatagtttttgtccttcattctgttgatatgatgtatcacagtgattgatctgtgcatgttgaaccatccttacctccctgggataaatcccacttggtcatgataaatgatctttttgatgtgttgttagatttggcttgctagtgttttgttgaggatttctgcatcaatgttcatcagtaatactggcctgtagttttctttttttgatgtatctttgtctggttttggtatcaaggtaatactgaccttgcagaatgaacctggaaggagaaactacttccatttttcagaatagtttgagtagagctggtattaatttttctttaaatgtttggtaaaatttagcagtgaagtcattggatcctcggcttctctttgctgggagactttttattacagctcagtcttgtcagttgttattggtctgttcaagttttggatttcttcatggttaaatcttggtagggtatgtgattaggaatttatccatttcttctaactattccaatttttttggtatatagctgctcacactagtctctaatgatcttttgaatttctgcagtatacatcataatgtctgttttttcatctctgattttactggatcttctctttttcttagtctggctaaaggtttcccaattttgtttatctttcgaaaaccaacttggtgaaaaagattaaattcagtaggtcttaaatactttggtactttaggagattaatacaaaaaagaaaaaaagacatggattcttcaaacatctcacaatgaagagaggataaacacattaattttgtatataaaggagggaggagatatgtacataaatgcttgtctaagtatagaatctctacagaaggatatgtgaaaaccaaaaagaatgattgcctttgggtcagaggactgggggactggtgatctgggataagagcacttaattttcattatatactatttcccactgttggaatatttgaatgtatatacagtcctttctattccgataaataaattaaaaagcataaaccatatataaaataacttttacaaaacaaagttaaacgtaagagatataaattacacttgatattcaaaggatagaaagatcctattcacctacagaagcagagtaagtaccaataagggggtggtccatgagatggatgggtagaatagatatataacaaaaatcattccagggaagagaacacctgactatagccacaaagttgggaagggatggggcgtgtttagaaaagtgatagtttagaagcttaggctgcatataaggatgtgttctttttctgtagatgcctgacaaaaaaaaaaaaaaactatacagttagcatcttaaagaacgcacatttaccatctcacaggttttgtggtcaggagtctgaattagctaggtcctctacacagggtctcacaggctgaaatcaaaatgtccaccaagactatggtttcctcttaagcatagggccctcttttaacatcactggttgctgacataattcatttccctgcagttttaagacagacactcacccattttcttgctgtcagtcaggagccactctcaacttctagatgccaccagcgattccctgcctagtagtccctcaataagccctctaatgctcccaagatttgaatctttctaacttcagagaaaacccaatcccttttaaaggctcacttgattagatcaggcccacccagataatggccctcttaactgacttaaagtcaactgattagtgacctcatcacaagtgactctacaggatgtgtaccctataggatgacgtattagtccattctcacattgctataaggaaatacctgacactggataatttataaagaaaagaagtttaattgactcacagttccgcatggctgaggcctcaggaaacttacaatcatggcagaaggcacctcctcacagggcagcaggagaaagaatgagtgcaagcaggggaaatgccagatgtttataaaatgatcagattttgcgagactcactatcacaagaacagcatgggggaaaccaaccccatgatctgattacctccacctggtcctgccctggatgtatggggattatgaggattacaatccaaggtgagatttgggtggggacatggagccaaaccatatcaggtgagaatcttgggagccatcctagaattctgccaagcatagctggtaacagaagatgagaacaaaaattctcaaaagctaagccaaaattaaatagttttccatcctatatttctgtctccaaacgttatgctacttgtaaaatacacagggataattaggccaggcacagtggctcacacctgtaatcccagcactttgggaggtcaagatgggaggatcacttgaggccaggagttcaggaccagcctggccaatatggcaagaccccatctcttaaaaaaatggataattacagttgcaactgagaaacctcccatatttggtaactgtctactctttggctatttgtggtactcatttattataaggcctatgttactgactgggaatatctacttctcccttcgcagtcttttattcaatataaaccattcctacctctgtttgctgtactcttggctgccttgtctgttactgttagattaatatttaacttactaaggtcctcctcactccacaaagacctagcctctttattacttttttcccgctattttcagccattacttttgtgaccttgcataaattcacactagaaaagtgtaagtattcaatggttatatagcttccaactttgtttttgcagttttataaccttatttgatgtattcaatgatcagtagtttgttctcatctacactgaatgactatagattttttaaagtggaaacaggtacataggtaaccaaagtatacagcttgcttgggaaccttcatcctcattatgtttctggacaaccacatatggatacagtatgggacatcccttaaccttaggcctagtcagctttgttgaacctgttatcaatacgcacatctggagttcccatctccttcatgatggcaaatttctggatctctctgagtgccccaggggcatgcttcttgaagcccactcatggatgtgcttctgagtgttgatggtgtattcttgtgtcaccacctcattgacagcaggagagcccttcttcttcccacccttctctgcaggggccattctgccaggccaaagttggaaagtaacctccatcttaactacccaagaaagaagaaaaacaaacagcatagctttggtgtaagcaaaatgtcaattctacagctacatggtcaataagtatacacataattaatatttctacaatgttgaatatgattatttaggaaaacaagtctcagagttagaaatacccacttctcctttgatctggcagcttatattcttctcacagacaaaaatcaaaagcccttgataattttgcctgctgattgggaggcaatgctgatagacaaagaagtagaacactatgaaaagaaggcctcctgatacagttgctagtctttcctgacaacgtggcatatggttccaaatcttcaaacagctatcatattgctacactgatttaacaaggtgatctgtattctcccaaattaaatacatgtagagcactaggataccttcttctgagaaaaggggtatttattttctttctttgatactagatttatagcataacagttaagcctgcaagtaccaactgagtttctactaagtgtaacacattgtctagtaggtgggtgatggtagcaaagagaagatacatgataaatcagtcatgaatcctgccctcaagttatatataataagtgaaaagaaaatcctgggagcagaatcgacccaattttcctttctcttctgatgtcaggtgggctctgaacacaatcctcataatccccatttcctagtttccatgcaccattgtgatccctccccttgagtatgggcaggacctgtggcttgtttctagtcaaaagaataagcaaaggtgacacgacagatgggatacatgtacatgactatgtgattatgttacacaaacttgtcatacccattttgttggagtctctgtcttttaccggctttaaggaagcaagtggccatatggccaggaactgcaggacgattctagttgctgaagctggctctggactgatagccagcaagaaattgaaaccctcagtcctacaaccacaggaattaaattctgccaacagctgaaatgagcttgaaaacatctccttccctaattgagccccagttgagaactaagtactggcaaatatgttgattgaagctttgtgagaccttgagcagaggattcaagtcagctgtgccctgactcctggccccaaaaactatgagacaacaagtacacattgctttaagccactaagtttatgataatattgttatacaacaatagatgactaacacatctttcttcttatattattcaagttgctaacatatcataagaggtaaactcaagtattctgaacatccagtcaccactggtgacatgaaatccccagcccacatgctagagaaaaccagagttggtcacacagccagacccttttgtaagattcaagcggcaatttgccaccaatattgccaaaatagccagtatggctgcccaattaacagatcaaaaactaaagatcagctgctaattcctgccttgtacattctcagagagtaaggaccttccatttcccgactaaatgctcagaatgagccatcaggcctgttaggtaaaaatgagaaatttgaaggatcaagcggccccgcagacgctggtagagagggcaagcttaaggtgtagaagaaaactgtcattcccacttaatccaaaaaagtaaaaatatatgcctcctattttctttcagatataataaccaccttttcttaaacaatagcttatttgggggcctgcattcattacaaacaaaccagagtaggcttatatatcatctgaaggttcttttttaaaaaatttcttttgagacagggtcttgctctgtcacctagactggagtgcagtggcacaatcataactcactgcagcctcgacctactgggctcaaggaattcttctgcctcagcccctgagtatctaggactacaggtgactgtgaccacagccaggtacttttctattttttgtagagatgggatctcactgtgtttcccaggctggtctcaaactcctgggctcaagcaatcctcccacctcagcctcccaaagtgctgggattacaggtgtgagccaccatgcccagctaatttttattttttcttttttgtagagacaggggtctcactatgttgaccagaatagtcttgaactcctggaggatagtaatcctcctgccccagccttcgaaagtgctgggattacaagtgtgagccactgtgcccggccacatgaaggttctttccattgttcttccagaagtctcatcatcacaggctcattgtagtataaatattttcacataaggaatgaaagtgatgtgttagcatgatcttatcaggatcaaggtaactaaaaacaaatgacaaggtttctctttttattattcaacattgagaagcagaaaagtgttcaactgttactgtatttatttaatgctcaccttttaaagagtaaattcagttagttacgtgttataaaatgtgagataagacataatcctagagtaatgaaattttctcctttgtaaaaggagattcactataatttttcatgtaaagggaacatgaaaccaataacctagttccaaatggacagctaataaaattaagtttgcacatttaagagaaagttattttaatttcctttaattgtatacaatgttaaaaaggctttttgcaaatcattaacagttaagacgtactttcattgacaatttaggtagacaaaatattcaatgttgtgtgacaaaatcattcttataacattagtaaatgcataagcacatttccaaaaattgcaagaaataaaagccaaataattggaaagaatacacatttactctaagtaaagcttgattatacgcccagagatgagcatgcaaagtatagcctaatctatactcccacaatgcctcaaggtatctctgagtgccctgtttgtgaacatctgggtcagttctatggctgacaccacaatgtcctaaatagggcatgacaataaatgaaatgtacaataatgtaaagcagtataacctctagatacaataaggcactaaatgtaacaacgttaaaaatcagcaatatagaagctaataataaaacaaaacaaaaacatttatgggggtttcagggggaaaaaaactaggcagagtaaatgaaagataatctgtaggttacctctattcgctcctatcaggggcaagattcacatcctggtctctcccctgctaatacctgatgaatcaaactgatgaacatacagccaatcaacgaagccaaaaaaaatgatacttaaaataaatacctgaaaagatggatcccacattacatcttacttaacgcttccaacttgctatgagaaagatactaagatacgcaaagttgaaagtgattcaaattccacactaacaatttaaatgccttgtaagagaaagaatattcacacataataatacaaagcaaagcatgagatgagtcatgagaagatacaagtaaagtgggaccagagcttagagggtgaaagacgacttctagctaagataaggaagggcatcacagaggaaggggcatttaagttagattttaaaagatagaatttgaaaatacagactatagtagccttcatttcaatcaaaagcagcagcatatgccttcataactgcaatgaaatattatgtacgtaattattgaatgtctctcttcctcaatagatgtcaagttctgagagggctgagactatactttttcaatggtctccttagtacctagcagaatatctggtatgtcacagatgttcaacaaatatttattaaaggaataaataaacagaggcaggaatatagaggacaaatcgctcaatttgcctagtaaatatagaagacagggacatgaagaacaaaagatcacttaaggtgaaatgacagaagaccttgaaaagtcaaactgaagaatgtttatttggttggaaataaggagtcactgaagatctttatggaatgtagtgacataactagatctgtgctttcaaaagtatatctaaaagtaatgtacatggcagactacaaaaaagataaaatgaagaagtcaagagatcattataggagtctagatcaaagataacaaggacctgaagtagaataaaggcagtgggaatagaaagttaaaaaaaaaaataacgacagggatattaaacagataaaatcaatagaacaatcagttagttatccattccacaaacatcttttgagcaactactacatatctaccagacactgccaggagctggagacaggaaaaataaaataagctgtagtccttcacctcagagttgagagtcaatctgtcatctcaataagaaaaactgattgaaaactgatctcctagctaagataaggaaaggcatcatagaggaaggagcatttaagttgaattttaaaagacagtttgaaaatgtagaatatggtagactttatttcagccctttcagaataacacaataaatgaagaaagggagaagtcaatgcctctcttaaattttgagaacagaaactaagaggatggcatcaccatgcagagaatggaagaacaaaacagaagaaggtggacagggaggacggtatggacagattctgacacactgtctttgtgtggaatacgcaagtgaaaatgttcctgaattagttgcaaattcagaactggaggacagagcacagattagggcttatgatttgaaaggcatctagcataaatatgagagctgaaattgagagcagacaaggtaagaaagggtgaaacatgtagaaccttggagatgatccatatttaacgagatgagagaaggcaaagggaagaattaagagaaaattatcagaaaatcaaaccaagccaaaccaggaaagaggagagcaatcagaggcaaaaggatcatcaggacaacaataagtgtttccagaagcatggaccatcaacagcattatttgcaacagagaaatcacggaaaattaggactgacaaaaaggccactggatttgggaataaaagaaatgtattagtgatatttgagagagcagcagagtgataagggaaaactcagtttgcaaggagttaaggtatcagtgaatggtgaggcagtggagatagctggaacaaactgctctcttgaagtctgaaaatgaaggaaaagaaaatgatggaacaatagcttgagggacaacagaaggaagaaaaaaatttaggctaaggaaagattatatgagtatgtcttttgttggagaaaaagtggacaaaaaaagcaacattttttttagaacaggaaagagcagagatagaagatccagtaaaggcataaatcaaagatgcataaaatacttgatgtattcattcaataagtatttattgaatgcccaccataaactcaaaactggagaatatacaccggagaacaagctaggtaggatcccaagctcatggagcttgtatgtctaagcttccagaggaaaaggaagaatacagtggacagggtagaatgcctttattctaccctgttgttgcagaacagccacagagtttggatggaattaattccactgctaccaatggtctcagaaatcagcatcatcttatctgtgttatcagggtatttgattcacgaatgaccacacaacctaagttggtcctatcagaatgaaacctgggactttgattaaatggaaaagaggacaatcctgatcgacaaaatgtgctgaggtgaggtcgggaactgttgcatacattttgctacctgaaagaagcccacttgtgctgaaggcaacatagaggaggattgagctgagagaattatggctgtaaaaaatgaaactctgatcaaaccacatctgaaacccatcctttctttggacttttcagttacatgatccaaaacatctctttctttgtttaaggccatttaagccgagctttttgataatttcaagtaaaaccatcctaattacaaattagatgtcactgtaggcacaagtaaaacggttataaaactgcagcacaaaataagacctgcccagtgcagataccagagactgtgccctttctccactcttctggctttagctgtctgtattagtcagttctcacgctgctaataaagatatacacaacactgggtaatttataaaggaaagaggtttaactgactctcagttccacatggctggggaggactcacaatcatggcagaaggcaaaggaggagcaaagtcatgtcctgcatggcagcaggcaagagaaaacttgtgtaagagaactcccctttataaaaccagatctcgtgagacttactcactatcatgagaacagtatgggaaagacccacccccatgattcaattaccccccaccaggtccctgccacaacatgcggggattatggaagctacagttcaagatttgggtggggacacagctgaaacatatcactgttcatggttctaagctttgaaactacaactcattctcttttttttaaattatactttaagttctgggatacatgtgcagaacatgcaggttacataggtatacatatgccatggtggtttgctgcacccatcaacccatcatctacattaggtatttctcctaatgctatccctcccctagcccccaccccgcgacaggccccagtgtgtgatgttcccctccctgtgcccatatgttctcattgttcaactcctgctccttctcctataaatcctttccccactcctccacccaaggttattttctcttcatcagcccctaaacttcaagagatcttagcagcctgggagcataagggcactcttcctctcagcagcatccaaatttaccccatcttcatgctccagaattaagtgagaggggcctatgacttgagcaacagtcaccaataagggaattcttgggcctaggcccagcgaatatcctttctgcaagtttgcccctgtggctgtatcaaccctgagtttccatcttttcgtatcaatctggctgacttctcttcctttgaaactagactcacagtgcatctcctcctggaaggcctccttcccagtggcccttggccgtcagatgctgctcctcagggttcccatgaaaatcaatactcacctcctcctagccacacagacatggaaggacagagctagatacaatgtgatgttgttcttactgggacaaggattacactttattttatttgtgtataacctacatgtgtgggggaaatgaatgtcacttgtaatgtggaggaatgggtgctggactcgcaggcaaaacacaagacttccaggcatgaggggatttcttacaagttgcaggacctctccaagattcttaatctataaggactttatcactgggttgttgtgagattaagaagcatactgaatctgaaaagtattgtagtcctttgagaatgatacctagaaatatttttgttggatattatgaatgttcagaggaggcaagagatgccttcttgctagggattgctagggaaaaactggagacatagataagtgaaaaactcaagaagaagctggcctttaagctgactttggagaatgtgtaagatttagacatgctgaaatggggatggggagaggtagccaggtgaaggaagccaaaagctgagaagccagcatcaacttagcagctaattttactaagcaaatatgtgccaaccactcttctaagtgccagggttacaacagtgaaaaattcagaggaggcccctaccctaagagggtttacattccagttgggaaagacagacaataaacaaagacaaagatatgaaatgatttctgttagaggtaagtgatgtgaaggtgatgtgctatggggactggaggggaaacattccaggtaaggtagtaaaggccattctgaggtgatgacatttaacctgggaagaaagtgataaaatagagtggagctgaggaagaatatgccaaaggaaataccaggtgcaaaggccctgaagtaggaacaagcttggcgtgtttgtaaaaccagaaaaaaaaaaaaaaagccaatgtggctacagcaaagtggacaaaaacaaaagtagtatgagattaaggctgaggttatatctaagtaacagcacggtgtcagtttagattgaagtttgtagtagtagatgatccttgaaaacaaatttgggctagaattagaaaatctcagacaccaaattaaggtggatatatttcattcttcaaaagcaattgtctcacaatataatgagccaggtctgcgaggcaagtcctcagggatgcccacagatatttctcataaattaggtgactcttgtggaggtcatgggcacttaatccagaacaccaaggcagcaaggcaaagcagctgcgagactgttggtgacgtggaacacagactgagcagaaagttctctagctcaatttcccctgttgcaggaagaaatgaagcccagagaagaaaacaggcctgggaggagagagagtagacatcataactgatgttcaccaatacgtggttctcctctagttctgcccaaacaagaatgataatgtgtcactttgggaccaaagcatttaattgctggtgtttggctccccgaacctgccatggcaatcacttgttaccatggaggtgttatagacaggtacagtgtagaatgcagagccaatatctggagggaggctgccatggagaatcccccagatccactctggtggtgttaactcactgagaaattggaggttgtttgttatggaaggataacctaacctgtaatgattaatacaggatatagacagagtttttaaaaagaccagaaagagtagacattcttgctctgagtggggaaaggaggaggagagaatatgagatactactcaatgtctctgacagcatgcattttttgccccaattctccattcttggctagatcagtgacctttatcagatatgtaagccttgcacaaaataccatagactgggtggattattaaacagaaatttattttctcacatttctggaggctgcaaatctgagatcagggtgccagcatggtagagttctggtgtgcagatggccaccttctcgctgtgtcctcacatgacaaagagagaaagagagcaagctctctggtgtctcttcctataaaagctctaagcccatcatgagggccctaccctcatgacctcatctaaacctaattatatctcaaaggccccatccccaaataccatcacattgggggtcagggcttcaatatatgaaattttgggcaatggatatgattccatctatatctgagtgttttctcccactctttggtttacactttggccatgtgatttgcttggctaacagaatgagctggaattgacagtatatgccagttccaaagccaagccttaaagagcccttacatgttaacagtttcccccttgcacctctgctatgggcatgagaagaacatggcatggctagaccattccacaaaggaggacagaaatacatggagtactaccaccactgcaaacacatattgcaacaatctgcaacatgcagaaccacgacccaccaagcctgcagcataaatgacaaatgattatgtttttaagacagcaagtttgtggtggtttgttaggaagcactactggggcagtaggtaattgatctatataatgactacaggaaaatggccaaggaggacctgtggctctttaggaagagtcttatgctaacaaagctgcctaggaaaattaagttgtactgctccaaagactcttctcttcaaatcctgttttcttatttaccttttccagttccctgaaataggtcctaaattcaactctgatactggtcagcaaggtttgtgaagaagacaaaagcactggggagggggatacagaatcataaagtaatacaaaaaaaaaaaaaacagaaaagaaaatttcaggggagaaaaatcaagtgcaatacaaaacaccaaaggaaatgagatctgaggtctctaagtttactaagaaggctagtcatcatgaagccatttttggacaccagggagacagaggcatgggagttcaggaaaaaacaagtggcaagaaaattgagacagtgagtttaaatcattgagtttagaaacgtaacaatgaaaagaataaaaaatagagcaacaactagtggagcaggaaatagaattcatttcctaatacagaagacctatatatataggtttctatatcagtgctatatcagtgctatatcagttttctgttgccacaaaacaaattattacaaacttattatctcacggttttgtaggtcagaagtctgagtgagcttagctggggtctctgcttcaagtctcacaaagccagcatcaaggtgtcaaccaaactgggctcttatctggaagttctagagaataagacctccgggcatattcaggtggttggcagaattcagttccacacagcaaataggactgaagtccccatttccttgctggctattggctggaggttgctcacaactcctagatgctgttctctggccctgcatgtgctcatctccatcttcaaagtcagcaatggtgcactggacctttatcatattttgaatgtccctgacttcttcttctaatagcagctagaaacaaatctgttcaaaggcccatgtgactgtattagacccagataacctccctaccttaaggtcaactgattaggaacctcaattatatctcaaaaccccttgtgctgtgtaacctaacataattatggaagtaacagccatcatatttacagtcctagaaattatggcagaaatcttagagggccatcttaggattctgcctaccacatgtacacatttaaagttgaaaaagatccaaaagcgaaaagaccttgaagaagattttaaatagaaccttgtattacacaaattacctataaataggaaggaaagaaatcaaggaaaaagtatgccatcctggccatagcaaaaaaaaagaaggatgccttttattggagatttgaagaaagaattaaaaaaaaaaagaaaaaaaaaggcagaggcaaaagacaccttttatgccaactatttactttgccaaaattagtatcattttaatttagatacaaagaaacatattctaggctctttgaaaaagttcctccagatggttacatctccctggagtgacagcacctagcgtagccttgcacatattgggaattcaattaaacactgctgaccatctgattgagaattcagaggctggagtagctgactcaatataaacatatggcttagttcccatcaaaggaaaaatcaagtcactctattctcctccccaacatcgcacctcctttgcaatgtaggagaaaacagatatgaactaataaaaatagacgatgtaacagagattaggaaacaggcaaactggagaatacaaaatttctctaattttaccataaaatcagaatgcttcagctaaggatcagcactgtaaatatgtcattcttaattcaattgcattcaatcagatcaatactttccgatcatggcttcaggatatttaagatggggaagacacaatctgagcccagctgctaagtgttgggggataggagaagcacacaaatgactatactgtgaggttgagctatattaattgtggaaagccaaatgaagataagaaaacaaattaaaccacttttaaccctcttaagagccatatgaaatatttatacatgagaaaaagcctcaggcagatcaaaaatatttttcaagatcatataccaagtatattgtagggtacagattcaaattcaagactgactccaaactcagtctctcccaaagaagaggcaaatcacctctggttggctagttggatgggagtttggaggctggtggagagaaaccaggaacagtttcttagggaagcagttatttcaggtaaaacttggaaagatatacacagttttgaaaagctgagatggcaaagaaggagaacatttccaggaggaacagcaaaaagcacagaagcaagaaatcaggatcaacatttggagaatggtgagtagatcaagtagcacaaactctttacaaataaagatagattggatgcacattctggaagtcaaatattggggttaataagttactgtaatagttcagggaagagcctaaactagaatctcagacatgaaaaaggagaaaaggagaagaggggactaatgtgaggagtcagatggaagattactctcttatgtttacattacagtcaacaacaacaacaaaaaagacagccaagtccaaaaactaagcttggattcaaaagaaaaaagtcatccctctgccaccctcttttgccctctagtctagaggttagtaaactatggcccacagggcaaattcaacccaccatctgtctctgtaaataaaattctactggaacacagccgtgtccactcatttacggattgttaatggctgctttcaccctataatagcaaagactatgtggtccacaagacctaaaatatttactttctagtgctttacagaaaaaaaaaaattgtcaacgcttgctctagttccatactccacaagccactcttatttgtttgtttgtttgtttgtgacagggtctcactctgtaacccagactggagtgcagtagcacgatcacagctcactgcaggctaaagcaattctctcacctcagcctcccaaatagctgggattacaggtgcacgccatcatgctcagttaatttttttttttttttttttttttttttagcagagacgagctctgtctgtgttgcccaggcttgtctcaaactcctgggctcaaacaatcacctgcctaggcctcccaaagtgctgagattacaggcgtaagccacttcacctggcctgttccaattcttttagtagcttgttctcatctaaatattaagcttatttggatatttcctgactgataaattatcaagactatcatttgaattcctattatagtaactgagactttggcttgcttgcaccatcagccttccccgcatcctccccactctccttccccaccacacatactttcctttccccgtatgaatatatatttatattcgtagtgtttgcaacattattgtgactacataaatattcttcattactgagccagataatgtaatgtaattatgtttatgtttccatgcttataaaaatgttattttctgaagttaatagttatcatttgtttcatttgcttagtttttcatttacctatcactattttttctgagtccaacacatttgttctgttcatttttttccaaacattcaaacacaccaaatacttcatttttatttgttcccctcaaaaccaccccccccaataaccctccatcctttttctctaatctgagtggttgctctcaaggcctagtgaacagttgcttttctggaacttctctctgccctgccatattgagtctgttctcctgaatcctatgtctttctctttattgattttctcccttgttttatggaagctcatcctccagaagctttctatgaaatcacacataagatataaattgtttaatccttccaggacttagaatttcttcattctgtcctcatatctaattgatactttcagccggatagagaaatctaaactgaaaaggatttccccctcagaattttgaaagcattgcaccactgtcctctaccagccagtgttgccataagagtttgatgccattctgatttccatccatctctatgtgacttgtgttaatgctttgtttcattttatactcccttcacaaagcttttaggaccttattttaatctatgatgttcttacatttcagaatgacatggctggtattcttttctcatttattgtgctagatacttgggcagccttttcagtctagagacttacatccaccggtactaggaaattttcttgtaatatttctttgatagcttccttcctttttcttgtcctctatttgtatcaggcaacctgtagctataataaggcttcataataaaccatcctaaaactcagagacataaaacaatagccattcataattgttctagaatctaccagtcagtcaggcagttctgctgatcttggttggatttggctagggagttctttttggtgttgactagacctcacacaggtatctggggtaggctggctgttagctgaatttaaatggtatttggagctagtgcagtggctcatacctataatctcagcactctgggaggctgaagcaggcagatcacctgaagccaggagctcgagatcagccttggcaacatagcaagaccttgcctctaccgaaaaaaaaaaaaaaattaaaattagccaggcacaatggcccatgcctgtagtcccaactataactcaggaggctgagccggaagatcacttgagcccagcagttggaggttacagtaagctgtgatcctgccactgcactctagccaaggagacagcgagactctttaattaattaatggtattaggtaggacagggacctgtttcatgagtctcatccacaagcatgttttcatgataatcacagaggtttcagacattgtatacacgtatcaaaatatcacactttagccaataatggatgcactttaaaaaaagaagaaaaaagtatcacccataaatatgtacaattatatgtcagttaaaataacagtagaagaaaaaatgtgctttttaagcctctgttgtgtcaagttttctataacaaaattgatcaaattgggtcacataaccaagtccagagtcagtatggagggcacctgcaaaaggcttggatacatgaattcatgcatggaacccctattggtcagatcttggaaatgctgaattgatcctctaattttcttttctttcctatgttccatctcttaggtttattttttttctttgttgctgctgctgttgttgatgatccactttctatgagatttcttcaatgttatcctgaaacttctaaaattttttatgttagttcataataaattttaaatttccaaactactttcttgttatctaattttacctgtttcatagcatccgttcttgttttaaaagtacaatatcttctcttattactctaatgaaattagtaagagtttttggaagtattcttcttgaattgcctctgcttccctcagcaggtgaagggaagtttcacccaacttcccacagcagagaaaggtatctgggtgatctaaaggctcttgtactttcaaccaagatccatgttctgctctgtgttttactcccagtttttgtggtgccgggagtttccaaatgtgagtctctaaagggtttgcatctcatcaatgtcttttctatagggacttcagaaaattaaaggtaactctctgcaggtagcattcttcctttatttttcatcttccaaaattttgttaagatctctcttctgctatcccaatttctttatccttataagttaataccttttaaagtcttctactgccatttcagtgagatttgaggaaggaaagaagaggagtttacatggtctatagacactctctccatttgcttttggacacagtgaattccaagtaacaccacaataataaagcagatatccaatgattgaaaacacaggtgaagctcaagataaaggtcagaattagagatgtaaattggagaactgcttatacagaaatggtttctacaactatcaaaggaaataaacaaaatataaaataaagacaaaatatccaatgatacaatatttagaaatgcctaagctaggaaaaagaaactatcaaagagctcaaagaaggaggaatgataaaaatagaagagtaagtgggttagtactaagtcacaaaggtcaagggagaaaaaggtttcaagagaaaaaaagacaatcaatgatatcaaatgctgctgagaaacacaggaagatgaggatgttgaggacataccatttggtgattaggaagatgatggtgaagtttaagagagttgtttcaatagcatatgagtacaaaagataaagaagtagatagtaaagtagataatgtattggtggttcttttttccccaataatctggtggccagtggaagacaaaaagcctgagataagtgagaggagaatttgaacatacatgaaagttaagaaaagtttttgtgtttttttggtttgttgtttaaggaaaaaaaaaaaaccttagcaagagtacaaaaggaaagatttgaggaaagaatgtaaatgcaaagatgaggaaaatcaaaggataataaaggactggaggagaaaggtaggatatgcactcatgagcacacatgcagaggttcatcttagaaaaggggaaggcattcttactgcaaggcagatatgcagggaaagagaaagaataaaagcagaggtagagagagacaccagaaaaaattctgaaaacctcatgcccaaatgtcctcaagctcagttaaataagaaaccaagttatctgctgagagcaagaatgaaatttatagagagtgaaaaaggtttggaacagctggtctggtaaatgtaatagggggtttgtgggggaggcggtatttattaatttacttaagaaatagcggcagcaagaaaagtctagataaagctattctaagttctgggagactctaaacaaaatatggatttagaaacagcaaaatttctgtttttcacaatagtagctataataatgagagatgctcagtgggtatgaggtaggtaatgtcaagtgatcagaataaaatatccaaaaattaacaaaacctgaatttttcaaaaggacttccttttgtattttactttttaagaagaaataagaaaaagaaaactaataaatcttcaatccagttctttcaacatttattccttgctaatttctgactaataaaagcgttaattccaggctaattaagccttcttaactgaccttcaaagttctcctcaactatgcctaactatatcaactccaatctcctttgtccaaacactactcctccactacaatctaaaatagttgcatttccatgcatagtagttcacatttgcaaatacaaaggctgctgaatcttagaatttatttatctctaccaatgaccaattgttcacaattaggttacttttggtcctgattccttttggaatttatatggaaagatgtaacatttacggagccattcattatcactgttgccttcaccctttccttagctaacagcagccacttgattcatttacctctaaagcattggttctcaaccagaagcaattttgcctcccagagaacacttagcaatgtctagagatgatttttggcatccagtgtgtacaggccagggatgctgcaatcctacaatgcaaaggaaaaccccaccccgtccccaacaaaaaaaaattatctggtccaaatgtcaatagtaccaaggttgggaaatcatgctcaaaagctacctcattcatattctaagacctataaataggtcaacaacgaaataaaacctgcctttggctcaagctcattctctcctctgctcctgatctcctacattcccaggccctttgtctgccttgaccattgagactttgattgcctttttcccagcaaggctatgatatcctgattctcagatccttagctcccttgggccatctgacacctaagatgcagttgcccctgtgaagttccaaaactccccaggcttgtttctcactggggggtctttaatccttgttttctggacttgagtctttgcacggtctggcctctaacataacctgactaatcctaatcatctatttctccctacaccccagggtgacaatatggtttgacagtgcacatcagagcagcctttaaaaggccttctcgagaccatcctggctgacacggtgaaaccccgtctctactaaaaatacaaaaattagccgggcatggtggcgcgcgcctgtagtcccagctactcgggaggctgaggcaggagaatggcgtgaacccgggaggcggagcttgcagtgagtcgagatcgcgccactgcgctccagcctgggcgacagagcgaaactccgtctcaaaaaaaaaaaaaaaaaaaaaaaaaaaaaaaaaaaaggccttctcctgtctaactttggagtctcagcattccatctcttcttcctgcagtcacctaaggggctgttacctatctccagaacaacagtttacatgtgttaagacctcattatatggttgctggaggaaaacatgaaccaataacttgcaggcttgagttacaaagaacatacatttaaaccaactgaattctggatctaacagttctttcattcagttaccaaaatatttattgaagtacagtaccaggcatgtgggggtgggtggcttaaaaaaagtatccataaatagctcacagcttagtatataaaatcagatatgtaaataagtaatctgtaattagactaattacagtcagattattcctattttataatatctaaagaaaattgtaaaagaaataaaatccttcctcagaattgacagaactaatggtcttaaaataaaagtacatgggatgaggctgggtgccatggctcatgcctgtagtctcagcactttgggaggccgaggcaggcagatggattccctgaggtcaggagttcaagaccagtctggacaacatggtgaaacctgtctctactaaaaatacaaaaattggccaggtgtggtggtgggcgcctataatcctagatactcaggaggctaaggcaggagaattacttgaacctgtgaggcagaggttgcagtgagctgagatcatgccattgcactccagcctgagtgacagagggagactctgtctcaaaaaaaaaaaaaaaaagcgcatggataaataaatgagcaaatgaacaagcagatggataaatgagaaaccaaatatcaaacaagtaaattttttctgggggtcttaggcaaagtggtacatcatgtaaatgagagcctcattattctactacatctcctttcttttcatcttccttaaatgtcattctcactataaatgctaattggtttagcatatataacaaattaatctgggtgatagaataatgctacaacacaatccatgctgaaaaatctttgcttctcagttttgcagataatgaagcctctaaacagacatagcccaccagtatgtagacagaccaggactgatactaggccaaaagacaccatgtagcctctccagatgtttacagccagtgtgcatctgactggtcagtgcttgtgcctcatcagtggtaagttgttttaatgtcacccttgatcagtacattctctcaattttagagcagcaggcagggctcccaagaagagatttcataactatattatgttcattctccctttaaaagtataaaaattccaattaccaattgacatagcagaaagcatccacctggttagactgacttttcctctgcataataccttgttaatccatcataatgatttattcatattgctgctgcactgagatatcagatgctacaactacgattatcactgttcctcgtaaagtggagtcttacagagctggctttgaacccaagctctatcaggtactgtctacgtgatgttcaacctcttctaggctgaagtacgtgagactttaaccaaatgcaattgaggaaaataatatttaccttagaggtttgttgtgagcattgataaggagacgatatatctatacagactagaacataccaggtgcttaatgaatcctagcttctccttttagccaaatctgatacaaacatattgatcaagttctttcccttccttcctttcaccatgtgatgcctgctccccttcaccttccaccacaactttttcttttctctttgcttaattttctttaagtccctccaccttatcggcaatttactttttcatttatcaaaagttactaagagcacgagcttaccactgcctctcccaaaatatctcctacaaatctctggaatccatagtgaaaagtagaaactatgattccaaatttgcctttaccctaaacacattgttttgcctttgttttaaagtggcttttccctcctcatctctgataattttccagcattaagagcattggcttttgagtcaagcaatcttggattccaaatccaattctgttgcttatgtagtcgaattacttacctggttgacttattaaatttctgtggctctcactgtcccaaaaactagaacatgtatggcaatgggcacaatgcctagcacataataggtgctcaaatatatcatatttaattgttctcagcactggcattgctaaccaagactaccttctcagtcaacaattagtctcaaagatacaatccaaatcatgtcccattagcatgtgccctgttctgtatttattcactcaactaatcatctcctgaatgctgtatatgttctaggcataaaataaagacatttgtacagcactttcaaagataactaaaccaaagtttcagacttaaaggaactcattgtctagtgggaaggcaaacatgtaaacaaataattacacggcagtatactaagtgctaaaaatagatgcatgtacaaggtgccagggaagcaccatagagagagatcaggcaaagcttccttgaagagatgactatgccagagttgagtctgggaggatgagcagggattcactgagcacacaagggaaagacggacattctgggagagacaggggcaggcaacagtggaaagtccatgatgcctgctgaaaacaccaagtacaggaattgagtcgggttggagagtgctgctacaaagaactggtgaaaaaatggggcagttaggagggagccaaaccacaaaaggcctcaagtgatgtgccaaagagtatggactttattcattaagcaatggcaagccactgattttttttgtttttggggggttttttgagacagggtctcactttgtcacccaggctggagtgcagtggcacgatctcagctcactacagcctcaacctcctgggctcaagtgatcctcccacctcagccccccaagtagctgggactacgggcatgcaccaccatgcctagctaatttttttgtattgttagcagagacggggtttcgccatgttggccaggctggtctctaactcctgagctcaaacaatccacccacctcagcctcccaaagtgctaggattacagatgtaagccactgtgcccagcctctattgatatatttctaagtcaaagaataacatgtttataatggcagaggaggaatcaggttggaaggactgttattggaagtggtgatactgagtggacagaagtagtaaggaaaaacgtcaggcatggctctagagtttctagtttaaatgatgcaccatagttcctaacacaaatgatgcaagtaacagagcagaactctgggtacagataattaatgttttgcatttcatacctccattgaggaggagatgttcaataggacaccggggataacatgtctagcgtgcaggagagagaaatgaattacagatacaggtttcgggtagattttggagaataataatttttaaaaccaaagaacatgctttttttttttttttttttgagacagagtctcactctgttgcccaggctagagtgcagtggcatggcgcgatcttggctcactgcaatctctgcctcccgggttcaagcgattctcatgcctcagcctcctgagtagcttggactacaggtgcaggccaccacacccagttaatttttttttttttttttttttttgtattttcagtagagacggagtttcaccgtgttagccaggatggtctcgatctcctgacctcatgatccacccgcctcagcctcccaaagtgatgggattacaggcgtgagccaccatgcctggccaagaacatgctttttaaaagaaatataattcatttagacttctctcccaacttcaagtgaaaagattacaaattaaaaaccttaaattactatctattgcatatatattaaaatctaacattaaaaaatatggaaagatgtcaacacatttaatgaaaacaaaaaactttaacagaggtaagtattgtatatttatttgtctattactttgcttaagcagtctgcttgctaatataaggacattttccttacctataagagtaacgtatttccaaaataatgttttcatggccaaaaaaaagcataacgcttgcttcatcttctgaataaacaagtgtgtttaatttcctgagtaaacattagtcatagttgacactgaacagcgtccaaattcaaggaaggagttaagaaatttctaaaaccccaagagcaatatacctcacccagagaatctagtgaagagcttattataaaggactaaaagtcaatgtcataccaaaattttaaataacatcatgcatccctctacttaataaattatttcaaaatcaggtcacaattgacagacacactatcttgggcagacgggagagactagataagcagggaaaatttccttttctctactgaagcatgtccaccaactgtcatatctggaaaacagccaaaatgagcactttatttgcaaaaagaacaggagatttataatgtgagcaaaatgtgtgctatataaatgcagaatatagagaattattttaagattcatatttctgtatgtttagaaataatgtttcaaagacgtagattaaaaccacaagttcatctatataaaaagctctaaaagccaagggtggcaacgcttaaatccctatagataagctttacccttttcttctgggctgtgaccatctatgcgaggtaaggtttccttataaacttctaagacagataatctggcctcacaggtatctaaatgaattagccacataaattactctgagaaaaccacagccaaatcatgtctctcttaaccttcctttccttctgctccctaaccctctgttttctctttagtcacagagcattttctagtttcctgaccacggggtttaccagccaaagctgacacagctgagttgagaagggaaagcagctgaactataaaggaaggaaatcagagagaaaagaggcagggagtctggaaatgctaactagaggggaaataagaaaaccctggactgtgtctgaatctgtagaaacttgcaactctagattaatgtcctcaactcaggtgttggcggcccttagtcaactaagggtttgcgaaaattttccaaatgggttcctcgctaatctaaaataaatacatattaaaaatagtaataatggcagagtctcaataacatttatagccaataaccagggaaaaggaagggtaggcattcattttgagtgactttactattggaaactcctggacagttacagcattgctattaacacaattgtcactttggataaggtgtccaactgcatcacacagtattttggttctttaaagaagttaggggctgggcatgatggctcacacctgtaatcccagcattttgagaggccgaggcggacggatcatctgaggtcaggaattcaagaccagcccggccaacatggtgaaactccatctctactaaaaataccaaaaattagccaggcgtggtgacaggcgcctgtagtctcagctactcaggaggctgaggcaggagaattgtttgaacccaggaggcagaggttgcagtgagcccagattgtgccactgcactccagcctgggcagcagagtgagactccctctcaaaaaaaacaaaacaaaacaaaacaagacaaaacaaacaacaaaacaaatgaagtgagagaatttaaacagaaaggaagtgggaaaggtaaggtgaagaaagacttctggtttgagtgtattctcttaaaaagttcacaaaatcgctgaggtaataaacatttttccacatgcctcttttctgagattttgtccaccttctcctccagccatgaggtggggctcaaggagactcagcagcccctagtttatgctacaagatcctatctccctgccttcccctcatcctcactgccttgattcctggtcttttcaaggcctggcagttcaacatttccttgattctatgaaagacttctatagtcataaattcccattcccctttaaagaaaaagcaagcaagacctccaaggaaggatatattaaacatggatcttgtacccttttctgcaactcctttcatcagtgagatgatgataatactatagattagattgtggagaaaataggtatctatccatcccaagagtcaagagttttggagggatttttaaaggtaatccaggaacaaataggataggtactctgcatgttcccttgttctgctgatgaatgtcacaaaatacaaagtttacgaagcatttctatggacacccaaggacaccataaaaacagaaagccaagatacaaatactttgaaatactgtgaaaaggtcctacgttattagaggtattgataagaaaacaagatgttaagaaaagagtagaaatcacgatctctttagatccctagatgttttcttgtgtattaagtatgacattttttaaatccaggctggtttagttgtttttttttaattttactttaagttccaggatatgtgtgcagaacgtgcaggtttgttacataggtatacatgtgccatggtggtttgctgcacctattgacccgtcctctaagttctcttccctaaccctcccacccccatcaggccctggtgtgtgttgttcccctccctgtgtccatgtgttctcattgctcaactcccacttataaatgagaacatgcagtttggttttctgttcccgtgttagtttgctgaggatgacggcttccagcttcatccatgtcctgcaaaggacatgatctcattcctttttattttatggctgtatagtattccatggtgcatatgtaccacattttctttatccagtctatcattgatgggcatttgggttggttccatgacttcgagattgtaaatagtgctgcaataaacatacgtgtgcatgtacctttatagaatgatttatattcctttgagtatatacccagtaatggtattgctgggtcaaatggtatttctggttctagatccttgaggaatcaccacactgtcttcaacaatgattgaactaatttatatgcccaccaacagtgtaaaagcttcctatttctccacagtctggccagcatctattgtctcttgactttttaataatcaccattctgactggcatgagatggtatttcattgtggttttgatttgcatttctctaatgatcagtgatgttgagctttttttttttttttttttttgagacggagtctcgctctgtcgcccaggctggagtgcagtggcatgatctcggctcactgccggctccgcctcccgggctcacgccattctcctgcctcagcctccggagtagctgggactacaggcgcccaccaccacacccggagaattttttgtatttttagtggagacggggtttcaccgtgttagccagaatggtctcgatctcctgacctcgtgatgcacccacctcggcctcccaaagtgctgggattacaggcgtgagccactgtgcccggccgatgttgagcttttttacccgtgtgttggccacgtaaatgtcttcttttgagaagcgtctgttcatatcctttgcccactttctgatggggttttttcttgtaaatttgtttaagttccttgtaaattctggctattagacctttgtcagatgggtagattgcaaaaattttctcccattctgtaggctgcctgttcactccgatgatagtttctttcattgtgcagaagctctttagtttaattagatcccatttgtcaagagttctcttcttaaggtagtaaaactaaaattcagatcatctttccattgagtttgttttcccaaacctagggaaggagagcaggaactggtaatagtgcctgctgtttattttttcttaaatgtggcatgcaaagctgaatgatcttttaaagtacagaatataactgcaatgaattatttctgcaatacttccaactatttttcccatttctttgcaattaatgatagcatttttttggctatagcaaatgtttactaaagagcttcctggacgtttctttgcttagatttatttctaggaattatagtttcctgatagtaacttaaagcttgggaaattcccagtatgaattacttactgtcctggttcatttgaagcaataatcatttttataagacctgtgcagatgtgccatattttataatatacttgtgtcaatttccagacatatttttatgacattttaaaaatcatagtgggaatatcatataacaagaaaaacctacttgctggaatccttatctctatcgaattctgcaaactcaacttcttcagtgaatgacagttaatatctcagttcttttataactctttttcggcattatcatcatcttactaaaattcttgagaatgcactttgctgataattatgataaagaaagaccttcagctaaacagcaaaaaaatatataaagattttctgtctctcattctggaggcctactacatgtccacaacactatacatgaaaaaaagcccattaaagaatgcaaagtgctgaccagcctatcaaattatcatcatctctcctccaaagtgcaaggagaaatagtatccaggagaattgccacacagtgctcatgctttggtcataatctgatgttacctaaaatcattaattgcccaattttcttccaatacaaggtacagccaatgctgactttgaaagagatattatcattgtcatcacctagataaaaagaagagcctcctccactttctcttccactccctattcctcttttccttccttctcatttcccttctcttcctgaaaaattcagttcctacactattaagtaacacagagaaaggtaggtgtccacatcagaggaaagatggaaggcacagtggaaaggtaggaggtgtgtccatattggggcaggcctagtgtggcgtaccatagcctaagtgagagggcatcccttctggcatgatatgagagggttagaacccacacagggtgaagagggtgcccatgtggtgatggcagaggggaacaccccagcatgggatgtcagtatccaaacagaatgagagggcatccacatgcaagggtgacctagtgcagggggattagagtccaagaaggatgaaaagattattcccctgtagatgcagaccaggagagagtcagatatgaaaagggtgaagaggtgtctctgcagaaggacagcctagtgtggggtgacagagcctaagagggaaaaggaggacattaacagaagggaggggacgatagtggagaggagattgatagcatataagacgacttatcaaataagtatatatacaaagataacagaagccagactggaggatgaaggaagttacaataaactcatatttttaataactatagagatgtaaatatgtgtacacagtgatgtgaatatattcactccctggctgagaggatctgggagatatgacactccaaaagccatgagcataacaatacccaaatcttagcttctaatggcccactttccaataaaaggaaccaggccacttggagaaaaggttgattccagggctaaggcaggaaaagatgagtcctggaacattttatgatgccaaaagcaaggaaatgctcaaggaatggctcaaaaaaaaagtcagcctaaaagggatcctactaagtctgagataatttaagcatcaaaattaataatgatagcagtgcattataacctaggcaataaaacagcaaaccatgagtccacactgatataaataaatgaataaaagaaagtttgatgaggaatgggatatctgcataaatgtacctccacacaaaatagttattaaagggggaaaaaggtaattatatatatagaagtttgacaaccaccatcataagcaagtgattaaaatgaacattatcagcaacgggacagatcaaatcccatgccacctgacaggatacaatgaaaagaacagagcatccctctgtggcattcccaccaaaggtgcacaacctgggccaggcacggtggctcacgccagtaatcccagcactctggatggccgaggcaggcagataacttgaggtcaggagttagagaccagcctggtcaacatggtgaaaccccgtctctactaaaaatacaaaaattaggcgcatatttgtagtcccagctactcaggaggctgaggcacaagaatcgcttgaacccgggaggcagagcttgcagtgagccaaaattgcgccactgcactccagcctgggcgacaaagtgagactgcatctccgaaaacaaccaaacatcaacaacaaaaaaagtgcacaacctgaatgtaataataagaaaacagcaggtaaacccaaagtgagggacatcttataaaataactggcttattgtctttgtgtcaagatcacaaaagtcaaagaaagactgagaaattattcacactcaagaagactaaggaggtatgacaactaaatgcagtacatgattttgaacttaatcccaataaagacattattgggacagttggcaaaacttgaatgggatctgaggaataaatggctgtaatgtgacaaagttaattttcttattttagtgactgtattgtggttaggtcgaagaatgtccttgtctgtaggaaatacaaactaaagtattctggggtgattaggttgacaacttacttgcaaatggttcggggaaaaaaaaggttatttaaactatatttccagattttccataatatgtgattatttcaaaataaattttaattttaaaaataaaaatatttgacagtatgtagttctacctccaaacattaaagaattacctgaacctgactcatggtcggatttagatctgatgtatgatgggagatgagagccaaatgctgacaccagactgctcaaacgaaaaagctaaatttgtgagtttttatgccctagtaaaattagatactactgtatagttagctattatctcatgtaaatgatttttgtaagggcctagagagaagagtctattttccagcctccaaagcaccatcaccatactaaatgcatagtgtacacctcaagatatttccataccataaaaatatgtctcaaaatattttaatgcttttaaaaaggagaaaatagtaatgataggcttactaggaacccattaatctcatggattacagcacagcacatacaacttccgtggaacacaatttttttctgttcaagttatctttgtgaggaatgtacaagatagaaaacaaatactaaatctttggtgaccagtaccactcctaaaagcaaaaggaaaaaagcaatcctctgcctctgggatcagaggaagattggccaagcagtgtcactccctatggcctgtcttggtgcctacagttacaccattaaagatttaggttaagacagtgtaaacaaatgacttattataatgcaaatattccagagtttcccattcaataaaagatactcatgaaatatataattatgatttataattatgaataatttattgaatatctaaattatttattgcatagatattaatgcttagtaataataagcattttatttcctcctgtgtaataggcactgtgatagatattttatataaattatctttaaccattccaactctacaagatagatgttatcacctccactttataaataaggaaactgaagcccaaagaagttaaatcacctgcatagcgccaaatgtcctttcagttgcagagtctgcattcaaactcaagactcggaatttttccattacggttttttcttttcttagagattgggtcttgctctgttacccaggctggagtgcagtggtgtaatcatagttcacagcagcctcaaactcctgggctcaagcaatcctcccgcctcagcctcccaagtcacagggattacaggtacaagtcactccattacattctgcttcttctttcactatgtaatttactattctgaaaaatagaacctggcgcagtggctcacacctgtaatcccagcactttgggaggctgaggcgggcggatcacaagatcaggagatccagaacatcttggccaacatggtgaaacgccgtctctactaaaaatacaaaaattagctgggcatggtggtgcatgcctgtagtcccagctactctggaggctgaggcaggagaatcgcttgaacccaggaggcggaggttgcagtgagccgagatcacaccacggcactccagcctgggcgacaagggcgaaactccgtctcaaaaaaaaaaaaaaaagaaaaagaaaaaagaaaaatggagatctatggtatgagggaataaaatgccatataggaaagcttcttattggtacaggataaaactaaattatgagacttctgagtttggggtagaagaagccaaagaatgccttagaaccatgaaaggaagaaaggctaagcaaagggacataagggcacaggaagaggggatgagaaaggtctaaggacaaactgcctggttccccagttttcctacacagcctaacactagagttgacaaaagtccctgaattaataatgagctcagttaaaaacgacaggcttagatttattggcctgaaagagatggatcataaatgagggctgtgggctgggtgtggtggctgacgcctgtaatcccagcactttgggaggccgagacggatggatcacgaggtcaggaaatcgagaccatttggctaacacagtgaaatcccgtctctactaaaaatacaaaaaaaaatagcccggtgtggtggcgggcgcctgtagtcccggctactcgggaggctgaggcaggagaatggcgtgaaccctggaggcggcacttgcagtgagccaagatcgtgccactgcactccagcctgggcaaaagaccgagcctctgtctcaatcaatcaatcaatcaatcaatcaatcaatcaatgctgtggtgaacactgtactttccttctttgtgtgaaaggaatgaggacaaataaatcccacgtacatggtttagatgtttgttccctccaaatctcataccgaaatgtggttcccagtgttggaggtggggtctggtgggaggtgcttggatcatgggagtggacccctcatgaacggcttagcagcatccccttggtgatgactgagttctccaaatttacatgaaatctggttgtttaaaagtgtgtggcacctccctgctctctctcttgcccctggtctcaccattttatacactggctcacctttgccttctgccgtgattggaagcttcctgaggcctcacctgaagcagatgccagcaccatgcttccagtacagcctgcagaaccctgagccaattaaacctcttttctttataaattatccagcctcaggtatttctttatagcaacacaagaactgacacactcgcccatctggaaacatgggatggacaagttattaaaatacctttgaagacaatagaagttagacaatatcaagcacctagaattttgggggtaaaaaattccacactgggtttttgtgggggttgttctggttcaggtttttttctttttgcccaggctggagtacagtggcatgatcatagctcactgtagacttgaactcctgggctcaagcaatgcttctacctcatccccctgagtagctaggactataggtatgcgctaccacacccagctatttttatttttttattttctgtagaaacaggatcttattatgttgcccagcctggtcttgaactccttggctcaagcaatcctcccgcctcagcctcccagagtgctgggattacgggtgtgagtcaacacacctggactaacactgtatatagtgaaaataactgacaagggcatatttttaaaatgtctttaggtgatttactttaccactcagttcagtttactgttcatgtgctatcaagaaacaaatttaaagcaaaatactgccaataatatgaaactgataagcacacaaaaataattgagaactatgtaggaactgaaatatattactatataattttgtagaaaatgtactttccatttacatgttggaaatatattggtatattcatattttaacataagatatgcattgatccctatggcactaggaagcaatacagcacaattgaaagatatctgggatcagaaacacctgaatttgcttcttgaatctgcatgagtactgattataaaactactgactttgtaactctgggcaagttattcaatttttctaaccttttcacccataaataaaaatggggaagacattgcaagacttgtaaagattgaagaatataattttatgtaaaaaaagtggcctgtgtgatgtttacaacattgcttataataataataaagtcaaaaatcatccaagtatctatcattaagaaaatattaagtaacaacagtatatacaccagattagtggttctcaaattttagtgcacataagaatgttctagggggttgtaaaatgcatatttccaggccttacacttagaaattcttagaatactcagaaatcctggggtgggatcaggaaataacacgtttaacaaacaaccataggtgcttctgatggaggacatctatgaaaagtatgcagtagatggaatacgatgatgccattaaaaataactatgaagactttgaaatagcattgaaaaggtgtatgatatacccttaagtgaaaaattcaggatccaaacttgtacgctttatctgataactacattaaacatgcttaagaaaaaagttgtttttagcaataagattaaaggtaatttttgatcttttactcaaagttttaaatagtcatgctattattataaatgaatcactaacacattaaaattgaaaaaaaaaaacacattggatcctcatggccttcaggattaggctcaaactccttagggcaacacacaaggtccttctatctccagacttagctcttgtccatgctccatatcaaactacttataataccccaagctatattctatattttcacacactattattgaatatactgttccttctgcctgaaatgccctttctccaacttgtctggaaaattcctattcatcccacaagattcaagcactacctcctctctgcagtttcccctgaatactcctccaagtcaaattctgggtgcctccttcttgctcctagtattcctacagcattatttggtatttccattgctccatatatcaccctgtattttacctttttgctgatagatctatcccattattctgcaagtacatggggtaggtagagatgatctcatttagttttagaatccacaaagtactcagcaaatacttgttaaaataagtaaagacctattttttgttatcactgttcttagttatcagttttctaaaaaatcctgagtgccctgctggttagttggataacacttggctcaatgattaatgagctttgtctaatatatacatatatatatacacacacacgtagcataaaacaaacccatgaaaaatttttaagaaatagtttaaccattgtttgtaattcttcacgttctctgcttatgtcttcaaagtttctatcaaccttcaggatgacagaccactctggtcaatagccaaagcaggctaacaggaataactctgctctgggctcctccattgctggagtttacccagccaaagaacatccctgcagaattcttgctgcttcccccaaacacactcccactcactgccatctccgcactagcagtaaaatatctatataaaacagagataattctgtaagtaaatagagcagttttttagtatattcaaaacactagatactatatttagtatatttgtgtaatacataaaacatttcaaatgcagattactaactagaggtaccaaacaagaacctaaagtgactaatagtaattcaggccaaaaaaaaaaaaaagaaagaaaaatcaatgtggaagaatactaattgagatccaggtatcagaacttcaaatgctttccctgtaccgtaaaacataagttttaggaataacctggatgctgaagccaacttgcaacacaatttttttaaaaagaaaaacaaaatacattttttaacatttgaatctcaagccacattaggcattaaagctgtgatacaactttgttccatatctctgtcacctgtgatataataaatgtgtacagaaatacttttagtgcacacttcatagatactgtacttttttaaaaattgaagatttataggaaccatgtgtctaacaagtccatttttccaattaggccaatgtgctcagttcatgtctctgtgtcacatgttggtaattctcacaatatttcaaactgtttcattatttttatatctgttatgatcatctgtgaactgaataatgctgtgtgtgttctcaccactccaccaactggccattccatctctctccctctccttgggcctccctattccctcggatacaacaatattaaaattaggccaatgaataacccttcactgacctataagtgttcaagtgaaaggaagagtcacacgtttctcactttaaacgaaaagctagaaatgaataaacttagtgaggaaagcatgttaaaagtcgagacagactgaaagctaggcctcttatgcctaacagttagccaagctgcaaatgcaaaggaaaagttcatgaaggaaatgaaaagtgctactccagtgaacacatgaatgataagaaagccgaagagccttattgctgatatggagaaagtttgaggggtctggatagaagatcataacagcaacacaacattcccttaaggcaaagcctaatccagagcaaggccctaactctcttcaattccatcaagagctgatggagctggggaagctgcagaagaaaaatctgaaggtagcagaggttcagggggcttaaggaaaaaagccatctccatgacataaaatggcaaggtgaagtagttaaatgctgatgcagaagctgcagcaagttatccagaagatctagctaagataattgataaaggtgactacactaaacaacaaaatttcagtgtagatgaaacagccttctattggaagaagatgccatctaggactttcatagctaaagagaagtcactgcctggcttcaaagcttcaaaggacaggctctcttgttaggggttaatgtagctggtgactttaacttgaaaccaatgcttatttaccattccaaaaatcctagggcccttaaaaatgatgccaaatctactgtgcctgtgctctgcaagtggcacaacaaagcctggatgacagcacatctgtttgtagcatggtttactgaatattttaagcccaatgttgagacctaccactcacagaaaaaaagattcccttcaaaatattacagctcagtggcagtgcactagtcacacaagagctctgatggagatgtacaagagactagtgttgtttccatgcctgctaacacaacatccattctgtagcccagagattgaggagtaattttggctttcaagtcttcttatttaagaaatacattttgtaaggttatagctgccatacctagtggtagctatagaaccactaagaacatttgcgggccaggtgcagtggcccatgcctgtaatcccaacactttgggaggccaaggtgggaggatcacttgagcccagaagttcaagaccagtctgggcaacatagggaaaccctgtctctacaaaaaatttaaaaattatccaggcttggtagcacatgcctgtggtcccagctacacaggaggctgaaagcaaagaatcactgagtctgggaggtcaaggctgcagtgagcacagtgatcatgccactgcactccaggcctgggtgacagagtgagaccctatcacaaataaatagataaaacatttgtggttcatgggaggaggccaacattaacaggagttttggaagaagttgattctaactcttatgactgattttgagggattcatgatttcaacagaggaaggaactgcagatgtggtggaaatagcaagtgaaatagaagtgaagcctgaaaattggactaactgacaacaatctcatgataaaatttgaacagataaggagttgcttcttatggataagcaaagaaagtggtttcacgagtggaatcgactcctggtgaagacactgtgaacattgctgaaacatcaacaaaggatttataacataacataaataaagcagcagcaaggcttgagaggagtgactccagtgactccaattttgaaagttctaccatgggtaaaatgctatcaaacagcatcccatgctacggaaacatcttttgtgaaaggaacagtcaactaatgtgaaacttcattactgtctcatttaagaaattgccacagccatcccaaccttcagcaaccaccattctaatcagtcaccagccaacaacattgagacaagaccttctaccagcaaaaggattacaacttgctgaaggctcaaatgatcattagcatttttagcaatgaagtattttttaattacgtacattgttttgttagatataaggatgttgcacacttaacagtacaatatagtgtaaacataacttttatatgcactggataaccaaaaattttgtatgactcactttattgcagtggtctgaaaacaaatccacaatatgtctgagctatgcctgtacatctaagtaataacgtctgatataggcaaataatatatgtttatatctaaaatgggtttatataatccaataaaaaattctagagactaaatgagtagcaaaaagaaaatacttttctatcaccagccatatactctctcatttctcatgtctccagtcaaatcccttccccttcagcctttaagaaggaagaattagccaggcatggtggttcacacctataatcccagaactttgggaggccaagtcaggaggatggcttgatcccaggagttcgagaccaacccaggagttcaagaacagcaaggcaggaggatcacttgagccctcaacaacagaccccaacagacagggtttccctatgttgcccaagttggtcttgaactcctggattcaagtgatcctcctaccttggcctcccaaagagctgggattacgggcatgagccactgtgcctggcccacaaatgttcttaatggtgtctagcatggtcaatcctttccagaaggttttcaatttactttgcacagattcatcagaagaatcactatgtatggcaggagtttgaggaacagtgaggctctgtccttataaaaaaaaatcaaaaaattggttgggcatggtggcacatgctggtagtcccagctacttggggtctaagacatgagaatcacttgaccctggggggcaatgaggctgcagtaagctgtgattgcaccacagcaccccggcctgggtgacagagtgagaacttgtctccaaaaaaatggaagaattaccacctgtatccaacattctcttacgagcctggcaaaatccactccatttgttctgccagaagaggtcgatggctttactattttggcctaatgttttgttgcctctttaaatgaaaatacgaaaagagctgcttctttctaaaagctttaccaatcaattacaacttcactatgaattaactgtcaggtcccacaaacactttttggtggtaaagaaaggaaagaaaaggcactgggtccatgacgttagaggataaattaacattgaggtataagcattccctttcctctgcagcctcaccagcatctattgtctttcgacttttaaataacagccattctgactagtgtgagatgctatctctcactgtggttttgatttgcatttctctgataactagtgatgctgagcattttttatgtttgttggccacttgtatgtcttcttttgagaaatgtctgttcatgtactttactcattttttaatagagttacttgttttttgcttgttgacttaagttccctatagcttctggatattaggcctttgtcagatacacagattgcaaatatcttctcccattctgtaggttgtctgtcagtgtggaaggtagtacagagatttctcaaagaacctaaaattgctaccattcgacccagcaatcccattgctgtgtatatacccaaaagaaaataaatcattctaccaaaaagacacatgcattcatgttcattgctgtgctatgcacaatagcaaagacatggaatcaatctagatgcccatcaatggtagactggacaagaaaatgtggtacatatacaccatggaatactaggtagccataaaaaagaatgaatccatgtcctctgcagcaacatggatggagctggaggccataatcctaagaaaattaacacaggaacagaagaccaaataccacatgttctcacttataagtgggagctaaatataaagcatatgtggacataaataagggaacgaaagacacagtggactactagagggtggaaggggggtagattaaaaaacagcctattaggtactatgctcactacctaggtgacaggatccatgctccaaacctcagtgtcatgcaatatttccatgtaactaatctacatacatacttcctgtatctaaaatctgttgaaaattttttttaaatattcagataggctggaatctagagatgatgccagctggcacaaaaactggagccagggtgaacttgtagtaattagaaaaaaacgctttttttctgagatgtgattgaggagggttaaagggaatgtggtgtgggaaatagaaacaggaaaggaggttggctgtttatgctcacatccatcaatcaagatttgatccaatttgatcaaagaatggtaacaagtctaagcagtttgtttcagttcagttaactagaagtgattaaccacttcaaataaagctactctcataacacaatagaatccaaataactctactgcacagcttaatcaaagttccatttcacaactagatccatgaagacatgtcatttaataagaaacatgattcataagaatcagattcagagatgaacactctggacagtgcagtagaagaaacagagtgtcttagtctattttgtgttcctataagagagtacctgagactgggtagtttacaaacaatgtatgtttttgtgattcacatttctggatgctgggaagtaaaagagcatggtactagcatttgctcagcatttggtgaggaccttcttattgcatcatcccatggcagaaggcagaagggcaagcaagcatgggcaacagaaagaggaaattgggctgaactcattattttgtgaggagcctcccatgacacctaacccactcccacaataatggcattaatccattcatacatgcagagccctcatggcctaatcacctctaaaagatctcacctgtttgttttgtttttattttgagtagggtctcactctgtcacctaggctggagttcaggggcatgatcattgctcactgcagcctcaaactcctgggttcaagcaattctccccacccagcctctcaagtagttggggctacagacgtgcaatgccacacctggccattttgttttgttttgttttttatagagacagggtctcactatgttgcctaggctattcttgaacccctggcctcaagtgatactcccgtctcagcctcccaaagcctgcgattacaggtgtgagccaccacgtccagacagatcccatctcttcatactgtcacaatgacaaataaatttcaacatgagttttggagacaacactcaaatcatagcactgtggaaaacaaaatttatcctttggtcatattttttgatccatcttcaaatatcaattaaaagcctcatccagatttaacacaaatgtaaaatgtatttgatatcctactgacaccaaagaagaaaagtagactcttaagaaaagtttctagatctgtattacacaagaaaattcaatgagttttcaactggcattgtgcctctgcctgcccgtacggcttacataaccatgtcctcacatgcatgagaaagaactggaagatagaagcgtcttctttgtaaattcctttttcaaatataaaatattctcccatatcaacatatgatgagtaataaaaactcactgtattttaattaactaacatcattctgcaatatgtccaaaacggaaactaaagacactctaaaatgcattaagtgttaaatatcttcaggttccataggttgaaattagtcttttctaacctttgtctggcattatagtcagcttccatttctagttaaatactcaggaataatgttctatcataggcttctgatagaattttccaaaattacctcaaaattatttcagtatataactgaactaatcaaattgtttactgtcacctgaaaggttaagttgctaaagtcagcagaggcactaataaatattatatgcttctgccttaatgtcagtgaagacttgcatcagcctttgtcatctgtaagaaatcgagtcacacaagaaactgtgcaatggatggacaggttgagtagtagtcactggctggctgccctagttcactgctacacatcaccctcagtgttttgaaaagggagctgaaaaccctgctcagtggagaaagaggtcaataccaaaattcaccctcctttctccttactccccatcatgcagctggcactgttcactctggcagatacagctccctgaacataatggtgcaatcaccacttcaaacatcattactatctaaaatagataacccacttgcaacttgactatttttatagatataacattttcatggagcttaactgctctatttgtgatttattccatttaaccaatgcagtttccctgaaagtgagtttcttatatcagggtcccaataaccacaattgcccaaatagttgtgaaaattacagtacttcctagttgtctgttatctccctgtattcatcaccaaaatgacatgagctgaatcctaaatctgaaaaattataagctctctggtttttatgtttttggtgaccagaagattgttttgctccacttcttattgatctactttttcacatggggatcttaagaactgtattatttatttctgacaagaatttactaaatacaccttatataaaactcaactcttcgaggcattaagaaaatcaaataaattgaggcattaataaagttttatcactgtattaaaatacaaataattctctatcctatactcagcaaaaaattaattaaatatacattttaaatggaaattagttttgtttagaataaaaggtagttgtgccaaaggaagagaggtttttttttaagattttgcagctgtctcataaaagatatgttaaataaactgaaatttcacataaaatgtagaggaagaaaaggagggaggcaactcaattttagtgctctgatgagctcagatttctttaaggatgaaagggggtagtaagaggtataactgcaagcaaacacaaaaaaagaaatatatacttgtccaggaaaaatgctaatgtcctttttagctaagtttgaaaaagagaaaagaggtgtaacagttcactaatttcaccttcagttctggcagagtaaaaggaaaactgtgggtagttttaaaccacaagataattttctatgatatctaacaatgccaagaatctaattcttcccaacttttattttgcttctattttccctattgagaaccattttcaaatcagaagggataaacaaataacttcaggagattactgaaggtccaaacgagaccataagggacagtaagctgctttaaataagtatgcatatccagacccagaagaattagatgcaagagggtagaaggaatttttgccaatactaggaattaccaatggctcactgccagaaacaagccataataaagtagactgattttgatggaatttaaaggatagatcaaaagaatgccatacacttaaatacagtgtgaatttagaaaggcagtagataaaatacctcacaatattctcacaggaacaatggagagaaatagctgattgtcattgcgtggcttcaatcctggtagaaataccatgagtaaagactgttacttttaaatttatactaagttgaagagaggtgctttggggatatagcacagtgtgttgaatttaggttatagaaaacatgcttattacatctctggatgatacaggggagagaagttaatacgctgaaagacagactcaagagtcagaaagaagaaaaaaaagagtcaaaaagatatagagaaattacaaatacaacataaaacaaatcagataaaaaggaacaggaataatttaagctcaatcaacacttttaaaagtaccagaaaggggacctggcttcacaggtcattgaaaaaaaaaaataccaggaaattttaattgactgtatgttcaacatgagccaacaccattacatggcccagaaaatcttgacctgtaggtaggtcttagatcaataataaagagataataatttcattgtatcatgttttaatagctgctattttattttaattacataatacatattcattacagaacactgaaaataaagcccaaccacaattccaccactcaaagatgaatactatcttcattttggcatcttatcattccagacttcttaagcacattataagtgttcaaacaaacttattttttcttgcaaaaataagatcatactataaatgcttcttgtaacctgctgtccttggttttcttattcagccataatgttctactctggtcaagggacatctactgcattttgtgaatttctagtcaccatactttaagagggtcattgcaaaatttgagaatatgtaaagaaggaaagagagagtagagaaaagtatgaaaactaagttcttaacatctatgctgtcttgccatataaaaggttaacagagatgatagctcttccatgaaaaatacttataagaaaacaaaaatacatgcatctaaagaactatcctgcagatgaattagactgctttatattgacccatacagccaatctactaccaattgctgaaagtcacagggaagtggattttagctcaatgaaaagaaaaattttaaaataattacagctgtcaaaaatagaatgaatctagtcattggaaggtttaacagggctggaataactaacaggtaagaaatgttacagagaaaatttccgcactaggtgagaagttggaagaaagttccctccttatttgacgattctatgattgctatgggaaatttactcccagtccaataggaagcaaatctttagtcattaaggccttaaagaatacagtcaagtgctttagaggtgcatgaaaaatattaacactaacgatgaacacctatatgctaaatgttttgcattcattactttatacttcatttaatccttataatgatcttatatgataggtactattattactatttccactctgatagaatagtgaggcttagagaggtttttaaatttattcaatggcattcttacatttgctgaaaattgcagtgccacccaaaagcatacctgattccccattacatagttactgttgaaaggataatttcttattaccagtagataacaagtaatcagaagcatcttcagaaaagttcttgtctagtgaaccctcaaagggcagttgtgagatttttttaattagaaaaaaataccaaaatttaaggaatttcaaattattcttcatagcaaaaaatgttcagattggcctgtctaaattggccacatacctttaaacttttgtgaataaaacagattcaatgaatgagacttaaaatgttgtaaaacaaatctgaatcacagattttcaaatctttgccattattaattaagtgaccatgggcaagtccttaatcttatctttttattccttcatctgtgaaatgacaatggacctcctaaggctgacacaagaattgaatgagatgacacgtgtaagcacttagcatagggtctgacaccattattacacaacccaggtaataaagcaagcggggaaaaagtgccaaacatattctacagttccttctaaaacattaagaaatttcaaagtgtcattatgtttgacgggggacacattttccattatcctgccaataaatttctgatgacaatcatttttgaaataaagtgacaactaaataaaatgtgccttcttaggaatgtcattttatgcaaatgattgcccaaagaatacaatttcaactctcattttcttcagacactattcagtataagatggataaaagcaagtttaaaggttattggttttgtttgtgatttttacaacttggttcgaagtactctaataaacacatgttgtttacttttgttttctatgtgcaatctttgttgtagagctactactactactactacaccagcaaaagagaaaacctctcactcaagatatacactgtgggtcactattttgatactttagtgtccactaacattaaatacttggtgttttatccctaaaacttgacatctattctttaaaaaaaaaaaaaaaaatcacagctgggaaaggagtatttaaaggatgtttgcttttgagttttgtcacaaggagtgtttttaaaatacgatttatcacaataaaattaagtgaaattctcactgttctcaaataattcctcatgttttcccgaagaaattgtttattttgagaaaattctttcagcataccagtttttagacataatcatttttataactgatggatccacagcaaacgttgttattttacgtgtaacttaaaactgtaaagagataaattgctttcacataaactacatgtgactacaggcaattattagagctgcaatctgaaatatgcacacattgtctacctgtgtttgaaagagaagattatttaacaagggagtacacacaagtcatctctatgacctattgaaaaaatgtcccataaatattcattcttctgacatgaactatcattccaataaaatgtcactgtcaacgagtatatagaataacatatggggctttttaaaatcccatcgactatttttcaactcaatttatttcactgtaatagaaactttccattttcccttttagctagccctataattaattgcactgtctgaccaccacaacctatgagaacttgtgtaaagaacgcaatgtcatcacccaaaagtttctattaagcacttgtcaagggtagcatggaacagtttttaaaaaaccagggaaatcacttgggctttctaaaatttttacaactatagttgggttatccaagagatgttttaaggcgaagatatgaatgacaattgatgactccaaaaatacccaggataaattggatagccacgattttagaaactaaagagcttcccttgaattgtatctagtgaatactctccaggcttcctccctcccagttgatttcatttgtccatcaatacaacttttaatagtttctcaagtatggaaatcaaccccgctatttccaaggtactgctgaatgaagaccttgacattttttttaaatgtcatcttagaaagattctccaagcaataccagtctcacctacgacatcttcacgttaaaaggcctctaccgtactccatatacagtatcccaataccaacctggcatccttcatcctgagctataacaaccaagtttcactcagctatgtccaggtaactgaaagtattgctggggctgcctaacctgccccatcaagttttatacacaccctgtgctgaagacatctcaccagaaagaaggttcactcacttcattttgtgggatcataacccacggcacagcaaacgccttctgcaagagaaggtaggagccaccgaaggctgtggcttttgcagggtaattgcatgcacgcaagagattctctgccaatttcatttaactagacaaaaaaggctgcgttcaaagctgcaaatatgtaataaatgttgatggaaagcgggcggaacgtcgattttcttcaagcaacactagtacatgtacaagttctgcaccagggctcagaggaaaagtagcttactgacgcattgatggaaggctattttaaaattactcaaagaatctaaggcatcaatctgactgggaggctcatacctcctctccatacacgcagtctgttttcctacctaatttaagaatgaatcgctggcagccaccaggtgcaataaccgtgaggaggaggacgtatatccatcacaatgcataatgaggtgtgccaaccccggagctggtgcccgtccttaccttagcagattagacaggggcaggggtccggatccaccgcccaggatccctcctttcctgccagacaggagtttctccaccagagccacatttccagtgcgagcagcttccagcagctcctggtccttccccatagtctctcaccgactcccccacagagtccttgcccccctcgggtcctcctccccacccacccccactccccaaaatccagggccctcttcgccccaccctaaaataatgcaagagcttcagcacggagagctccctgcagccccaggcagggagcacgactctctcctcctcttcggggcgcagcttttacaatggggatcagaccatgtcttgaaagaggggctggccgagctgggagccgcgacgcgcccccacagccactcccctgaattcccaaggcctcgttcccgcgggtgcggcgtgagggggtggggactcgggggtgcttttgaggagcgggaggagggtggtgaggactgaggtcggaggaggaggaggaggcggcagagagagtcctagctggagcgggagcgcag

SEQ ID NO: 1718 - DNA, 410827 bp, Homo sapiens
ctgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccggtggccctctcctgtgggacttgcgttccagctgttctcagagcgggtatgatcggcctccagtagacttggagggtcacgggtgagattttgataaggttcaaatactcctcactcctgcctccggtttccaccaaagttaccattgtactactaccaacagttgtggaaatttactttggcaaaggttttgtgtttttgtttgtttgtttttccccccaaaaattatgccaattaaatccgaccttaaatgacaaggcttttctctcatgtttaaaatcccatttttttccccttgccataaataaataaaaataacttgtggcttacaggctgcttaataccacaacattttaatgagcatgtcaggtaacccacaggcttcagttctttgttgcttacaagttccatccgtaagtgtgagttgctcacttagtctggggtaacaaccgcagattcccacagagaagaatcagtgtcttaaaacaaggtaataccaacccaatggtctatgaataggttggaatggcggtactttaagtaaaagtataaagaaatggttaacattatgaggaacttccagcagtactaataatcaaccctgttgttcaggagacattcacttgctaaactttaaggctaggcatttactgccttgaaagcaaagcaaatgaagattttgaccaactgcaacattcaggctctaaaatagaaatatgaatgaattattaaataataggtaacatttactgagcacttacgattttccaggcatctgtgcattatctcatttaattcttacaactctatgaaggtttcattatattatcctcactttacagattaaaaaaaaggcttagatctgcaactggtagttttggaagaacattcttttccttaaacaggaaactctaaatgccctctgttttgtccacctttgtgccactgtctgcttctgtgagggtcaggataatagtatacctgaaaccgcccttttagcaagcggcagggccaggacataagctcagactagatgtctaattcacttgctatacatgtaacatgtaaaataaaaaagacctgcatcttgactggtgtactctttgataaatgggacctgattacttgatggaggcatgtttgactatctttgtttatgacattagcaaactttcaatgggtttggaagtgaggctatttagttctgtgtcttactctgcaatccagacacctgtgacttgaggtaaagtaagtgttttcttggtttcccaatcatgagagtgaccgaagaatgacattttccaggtcatcattctcttgtggatattgttctctgataacaatattgggcaatctcaaagagctgtcatttcttggcagtgaactacaggctatttggaaaggaggtgtaaatcactttttcatcatgtccagtcctctgcactctagagtcatttgggatgttttgtgtctgcactacctctagagaatgatggaaatctaattctctgtcagcttttctacctggctagtgaaaatgcttcttgggagagctgggaggggaagtcgctgtccatggtggtcgttactgaagccccattcagcaaaatcggttcatactctaaatactggaatcctgcttaattaaactaaggagcttctgcacagcaaaataataaacagagtaaacagacaaccttcagaatgggagaaaatatttgctagctatgcatctgaaaaaggactaatatccataatcgataaggaactccaatcaacaagaaaaaaaaaagcattaaaaaccgggcaaaggacatgagcagacatttctcaaacgaagacatacaagtggccaacaaacacatgaaaaatgctcaccattgctaatcatcagagaaatggaaattaacagcacaatgagatagtctcacaccagtcagaatgactattattaaaaagtcaaaaaataacagatgttggtgaggttgccgagaaaagggaatgcttatacacaattggtgggaatgtaaattagcacaacccctgtggaaaatagtatagggatttctcaaagagctataaacagaactaccattcgacccagcaatcccaatactgggtatctactcaaaggaaaataaattgttatatcaagaagacacctgcacttgtatgtttattgcagcactattcacagtagaaaagatatggaatcaacctgtgtctatcagtgaatgcttgggtaaagaaaatgtaaatatacaccatgggatactatgcagccataaaaaagaatgaaatcatgtcttttgcagcaacacggatggagcttgaagccattatcctaagtgaaataaaaccagaaaatcagtaccacatgttctcatttacaagtgggaactaaacaataggtacaaatggacatacagagggaaacagtagacactgggaactccaaaagcagggaggatgggaggggactgaaactgaaaaattacctattaggtataatgtccactctttgggggatgagtacactagaaacccaacctcaccgttatacaacatatccatgtaacaaacctgcatctataaaaataaaaataaaaaataaacagctgttaattttgcaaaataagtaaatattacagtctggaaattaacttcatcatggcactaatgaaatttggtgatattctccagtactgtatattaaaacataaagatcttatcagtataatctactggttggagtaaaaacattaaataattcacaggagaatgactttttactctatggcactaaaatagcccctattcattgtcaaattttagatatttttaggtaccagaacagcataaaggggataaatcatttcctgaaaccctctcaccttacagcaaagaaaatagctacctatagaggttaaccaccataattagaagcaggcgtaaaaccatgaattcttgccacagaatcacttatcatgattctgtgatgcaccaggatattgaatgtcagaatcattctttcttcagtaatttcatttttttgcttaaaaacaatttccaatttatgtcatttgaaaaacagataatatatagtctgatgtaatatgtagctcatgttcatttatgtggagtgtatctaaatcttataatattctagctgtattaagtaatattgtttcctgcaaagtgagacagtagaaaaaactcttatggtaccaatttctgaccactgtaacccagtgaaaagcaaagcattaatttcattacaggtcatcaagaatgcaaccgtcaacataaactgcttatttaagagcagccattttctatcagaaaggactaatattaaaattccccactttcctatattctccctttgtattaaaaaattatccaggggaccatgttgaatattccagtctcaaaaatccaaagatggtggtaatttttctaagagatatgtaaggccctttgtaagatttagaggaataggattttaagagtttattcatttgtttagtagtagtataatgcaatagttaatctcctgactttggaataagacctgtggattcaagtcatgggtatttaacttaattgttttgtgatcttgagtaagttacttttttgagccatgctgttctaatttgtgatatgaatgtgataataatgtaagctacttcacaagagttgtggttggaaataaattagattaccaatatgtagtacttttcactaagtaccacactacttttcactaagtaccacacattggtaatatcatttggccaggttaaagtttccatttactcaatcaaagactaatctaggtgtttctgtgaaggtattttgtagatgcaattaaagtctatagtcagttgactttaactaaaggagattatcttagataatgtcattcaactagttgaaagtccttaagagcggcttccctgaagaagaaattccacctgtggacggcagtttcggctcatccacaagagttttcacctgcccttcctaatggcttgccttagctcagtcttgtccagccagtctccacaatcatgtaagccaattccttgcaataaatctttttgtatatgtctcctactggttctgcttctctgactgaaccccaactaacacaccatgtaaagcattaactatagtatctgtgacataataaacactccaaaatattagttaattttttaaattaacccttattgaacatctctcacatttatagcactgaggtatacactctgataaaaatgtctgagagctctgaaatagaatagggatagatagatacttattgtctccaatgatagtaacctcaaccaggaagggatttaatgttttagtaaaatttccaggaaaacaagggaaaagtgccaatgggttgattattccatctggagctatgtaggggaattatgcaaattcagtatgaggccagtttcctgggttaggaagacaatgaacaaaaaggcagttactgttttctcaacagatccatatagatgtagcacctgaaactagacacaccagtttccatggatcaaccatggaattccattctgtaagaaaaatttatttacgacttggtcttaagccaattggaattatatacttgataactgccttgagattcttggaggaagaaatacgctcatatttaagagtattaaagtaaaagatctttcttatttcaatgttagcttatcttagtattctacattgttagatctttgaatttgttttgtgcatttttaagcaaggaaaaaatacttatatcactaaaaagcaggcatagcacaaacctacttaaatagaatctgcctccgtccttcagaattataatgccaaacttacaaaacttaaggctggaaatatctcagatgagtaaacaaacctcagggaggtagtctcagatataaataggattaaaaggtgatgagaaagtaagagagagtgagagcatgccttttggttttatattaaagctctgataatttagagtgaatcttagaaatagaaatgttttaaattgtgtgtttgcaggtgtgtatgtgtgtattcactaaagacagctgtcccatgatcctttatgccataatagtaattttctcaaaggcagtgctattgctgtaaaaatacttttactcattatgcaaagatttattgaatacctgtgatgtcatatgtcgagctggttgctaagggataggaaagtaaattagagatggactctaatcttgtggaactctctctgggcaactctaatttatccttatggatttcaactaacacgtgactttctctaggaaatttttgtacttcccttgctctgcactggcctaggcagttctcttttgctctcacagtaactttgcttccactaatattgcatttatcattttttttagtaattagtcaattgcttataaatctccctataagactgcatgaggtcaaggaccttgtttatgtgaacctctatttttgctcggctcttgtcctcaaataggcattaggtaaatatttacagaacgagtgaaagaaagcttgggacatgttgaattttaattgctttccaaatagaaatatgcaggaagcagaaaatatataaacctggagctgaggacagagatgggtgcaagggatacaaatttgtattagctgattcctggtagttggaaggcctgggtggattatcttcaatgaggctcacatgtagaattatgaacgagaaagtctgaggtcaggactctggacagcgtccacactctccattttatctgtgggatgaaacatggcccacatggctaggatggaaatgttttgggaaacccaaagcccaaataaatcttttcaaccatgtgagtaagtttctaatagatatttcagaactaagttactgtagagacaggagcactataaatatggatttataatcatgacattgtggaactttacctcccaatatgtagagagcagggttttcaatttcgcaaaataaataaatgaataaatgttagcatatgttaatagagggcacaaaatagaagtcagagagagaaagagtgtctgtggggactcaacagactctgtgggaatcagactctctgattttctctctcaatggaatcaaggagtcccacgagttaggcattgggaaaggctctctgggtggtgaacagacatgtgtggctattggtggtgaatgtccaccacagaagcagcgtggctcttccttatactcaaggcttttttttgccattaatgagaagtaagacacagactgactcccagcacttaccaattttattattcttattgcctcctcatactttgccatgggaaaatccctgtttggatcacaaatttaaaacaatagactgcctgttaaccatgggcatatttacagatctgactatgagctaatacaacccagagtgagcagaagggacttatactttttcctgaaggcaagcaggcttggaatccaaggggaatgaatataaacactgagacccatctgccccagtcttctgaattaaaacctagggacttcttttgttaactctgttcaaggcccaaaccacatacagctccattgagccacagctaagatttttgcttgcagcctttgcttagaactggcccctgagagtcagtttcatctgtacagcacagttggtaagtacctcatccttcccacacctttaagcaacagaacagccacagtcaacacttacagcaactttcaaggttagcaatgaaagaagaaggctgcagtaacctcatctggatgcctgttttactaagtaattatacatcccaaatttcacaggacaaccttctttaaatgaatcagatcataaaatctgatttttcacttaggaaaatatggttaaatcatattagagactcatacttggagtcttcaaggaggtagcataatatacagaaaaaaagtccatggactccgaccgtggttcaagttcagctctatcatatttactggttgtagaccctgagcaacttgcttaacctgactgcacctcagtttctgcatctgtaaaatgaggataagtgttctttaaagatgttgtttaaggattaaatataagtacactcatataaaaatctagcacaatgcctggaccacaataattattcaaccagagaatcaagttcaccctagtacaaattcataagcattcagaatcaagaagttattccagcttatcaacagaactaaataataaagctcattcccacagcaccttctagtgtgcttatcagctgtgtaagtgaggaggagcccatgaacttgggaggggacagtaactttttatattgtagactcataaaaatgattttatttttttctctacaggatttttagaggacaaaatagtctctcatttgatggtgattatgtacattattatgataattctctaggaatgcacattaaggattttgaaatatattagaaggacaaaggaagaaagaatgacataataaatattaaaacataatttggggttgggataattgaatcttaggataaaatatggctgatggccattgttttttcctgctcaacacccggtgctctatttctgttaccaatagtctgatttgttactggggacccaactctcccacacttagctatgaaatcctagataatcaaccttaaaagagctggccatggagtggacccatgagccactggccaagcagaagattccatcatgcagccacagtggtttgttcagagacggtcagaaccaagactgttggaactactgggaaaaaggggaactcttctcactggggcttctgatgatgagcttggtattaccagggtgccaggtgtaatgcctggagctgccaagggccatcttgtggagagggtctacccaagagtgaagccagcgcagagaaaagcagagcagagatatggattggagtccagtgatagtttttgaggctctggatccagtcatgcctgaaacctttggactttatctcttatatgagccaataaatttttcattttacttcagccacttggagttggatttttggcagttgtaactgtaaagtgtcctgatttcttcagcagggaacttaagtataatttatctcaacctcccctctgatgtttgaatcttctctacaacttctaatgaaagagtcactcaatcaaggcttggactcctccagtgatagggagctcattaccaactgaagaagcccatccatctttgagacttatattactgcaaaattttttcttatatcaagtgaaggtttctgaaacctttgtaattaccacttattttgtacccagtagaggccagagaccctgtgctatgttatacttaaaaatatacattgtgatttaattctcaaattaaaaatttgaaaattttatttttgaaataatttaataaattaaattaataaaaattaatatctaatgatattaaaattattttagaagctgctgcacaaatccaagtgagaaatgatgagaggctgaagcaagggctatgggggtggggataaagaagatgaggagggatccagtgatgtacagatgtagcatacaggtgactgagtggagggtgagggcaagagtgaaacaggagacttggagggcctccagaaaatagacaggtgttgaaaagcagggagaaacaacctggatgggaaagatgaaggttctgctgtttatcccaagagttaccataagtcgaaggggtcactacttccaaggacacatgatagctctacaaatttctttaaaattttaactgaatctggtttagtgttaagaaataatcatgaacagaattggatgtgcatcaaaagcaaagttttagaaagacctgcaatttttgcacagacctttaatcacatgagtgcaagtcagaataacacttttatgttcagcccttaagactggtttctcccttctctcctcctgccagtgccccagaaggcagaggagaggatccagagaactcagcacgaagatgcagcagagtttgcctgagccacaggggatgggagtctgaccgtgaggtccaggaaccaaagagaagtgcattccagtggaatatgtttctaggaatgggaaagagggagaaagggaagaaacattttatgtatacctactatgtgccaggtcctttttatgtaggattattattattatttcagtatcactttttttttttcccaaatgtaaaaactgtggaggtctgcaaagttaagtaattttccaagatcaagcagcattagaattaagtccaggatgtatgtatgcctctgagatctgtaatttcttcattatgctatgctgtctccttaaataattagcagttataagacgcaagttataaggtgacaaaatacattgacatggtatctggattaacaacaacccagaaggctagtatttctaatattgtttctattttatagatgaggaaactgagtccctaagaggttcattgactagctcaaggccacacagctagtaagtagaaccatagctggaactaaaaattcccatctccaagatctgtgtattttcccatgacactgcagctactacgctgggcaagctactatgaagctggactttgtcagaacagtgacagataacagctttgctctgaaacgttctttccttcaaaggaacgcacccaacctaatgcttgtggtggcgcctgctttcacccacattggctcacaagagaaagactccaaggaaaaaaggaatgagggtccctagagtttctgatgagggtagggcggaggtgctttcaaggatggttaaccctctctcagggctgggcgcaaaggctcctgcctgtgatcccagcactttgcggggccgaggtgggaggactgcttgagttcaggagtttgagaccatcctggacaacatagcgagaccccatatctacaaaaaatttttaaaaattagcctggcatggtggtgcacacctgtagtcccagctgtccgggagggtgaggcaagaggatcacttgcgcccaggaagttgaggctgtagtgagccaagatcgtaccattgcactccagcctgggtgacaaagcaagaacctgtctcaaaaaaagagaagaaaaagaaaaaagacatgagacgtaggagccaggcatttttcagccacaaataccaagtggataaaaaaaaataatgaaaagaatagaagaatggttagcccactctctttctagtgaaccctgggataaggtctatggtgcagtgctgtgaaaattcactcaatccacgagatctatacactttgttgggacctgggatagaatgaaccagtgttcccttagaatggaaatgactgagtagaaataatgtgggaagccacattaactctttcaggccattaggctatcatttagtaaattactacattgttctaaatgggtccctagtgggtatggagggtgagaatgttctaatttgcttttctctcctttctctcagctgctttctcctactatgatgtagaacaagaagtggtttaataactgctctattccaaatcactgaatgctcttataactactgcataaaagtgcccctgcaggtctgctatattgaaatgtgtggaatcaaatctatgcatatgatatgaggggtgggggctgcaatctggtacccacaggatctagaagtaactcgaggaaccaggatatccctgattttaaattctaggttaatggagggcgtgtgaccgagagccccatgttcctggggagggaacagatgccactggaagctgcagggcaggagtttctccacctaaaagggaggatccacaactctgatctgaggaggagtccgtgtctctgccttggcatgtatattacaagagaaaatcataggaagggcaaggatgttccctgacgactggcttccctctgtcactcaggatgcatggccactgttggttgaaggaactatcatttttctccctgattgaaaaacaaaagaatcaaagctctcccttgtgcttacaaatctggggatattaattaaatacctagtagagatgctggggcctaatattattgcataatggtgattacagcaacaatgcattatatagcattaaatgtttttgaagcactttcatattcatttgttttttaaataatttttgtttttatttttttccagtttcattgaggtagaattaacaagcaaaacatgtacacctgtatgtattcaaggtgtatgatatgttgttttgacatacatacacactgtgaaatgatttccacaatcaagctaatgaacatatcatcccctcacatagttactctgtgtgtgtgtgtgtgtgtgtgtgtgtgtgtgtgtgtgtgtgtatgtatggtgagaatacttaagatctgctctcttagtgaatttcaagtatacaatacattattattaactatagttaccatgctatattattaggtctcctgaacttattcataactgcaagtttgtaccctttgtccaacatctcccctttgcatattcgttgttggtcagggctatcttgatggacatatgaagatgggctccatgcttggtttaattctctgcagtcacagtcttgtaattccaaataactttaacttggaattagtattttgtaagcaaggtctgatgggactgtggagcatgtgctgggcttggaacctcagcttgatgccgtcctgccttcctgggatgggtttttggctgccagctccctgtctcatgctggtcctgctcagggccctgcccactccacccccttaccccacaaccactgctgcaatcaggtggcactggcagggggaggaaagagaccagcttggattcagtccttgaccactctcttcccccaatggtggtggtgggggagtctcgacatggacggtcatccacctcatggctttttggggtaggcaaggcagcagccatccttgtccctaattgcaacatcatggcttgtttggtgggtgatatagtttggctatgtccccacccaaatctcatcttgaattgtagctcccataattcccacgtgctgtgggagggacccagtgggagataattgaaccaaactgtttaccccatactgttcttatgctagtgaatcagtctcacaagatctgatgattttataaggggtttccacttttgcttggctctcattctttctcttgcctgctgccatgtaagatgtgcctttgcttctcctttgccttctgccaggattgtgaggcctccccagccacatggaactgtgagtccattaaacctctttttctttataaattacccggtctcaggtatgtctttattagcagtgtgagaacagactgatacagggggcaatacagttggtgactctgcatgagtctttcacccatctctgactcaagtaccaagcacatcctggcctagggattgtaatctgttgggtagtcacctgtctgctgtgggttgggagtggtgggcctgtaggaaagggagattgacttccctgtccctggccaggcctcacagtttcattttataccaggccttgcaaaatatatagccagacctgtagttgacatttattgtaatatccatgcaagctggataggacaagaatgttgctactgttatgtctgcttccattatttctactgctggggaggctaccattaccttctctgtgacttgcacttgggcaagcacttaacaatatatcatcccatttaatcttcacaaccaatatacaaggtagggtttatacactggggtggttccctaacttctctgagttttagtttcctcatctggaaaactggtatcataatgcctacttggtaaggatattgtgagaattaaataagatgacatgtatattaagagatggaggtaattttatctacctgcattcctctaattctatatttgttaggaagaaatcttttggtaagctgcttgaggagaagagtcaccatggacagactaaaataacccaataagcttgcttaacttttgcacttatgacaaggagtagtgtttgttccttgccattgttcccaagaggaaggtggcaaagaaagagttggtgagggcgaagcatttgcaggggaagagaacaggagtgacagtatgtcctttagaaagtggaaatattgaatggggttctaaacaaattgtttggttgggtttatgctataaacagcccaacctacccaccgtcatgaaatcttcagtaaaggctgtgtagctgactaacgcttttgtgtgtgattagataaatgcgggagaggggctcagtgtctgttctcaaagaggcattgaaattcacatccacgttggcacaagtgaaaacagacagcttgtgccagaagatgagtgcagagctggtgtgtggttctaatactattcttggaatgcttcctctgagtgacctccctctctgttcaggccacgcatttctggagggtataacagcagtatattgttatattgtatatatatgtatattctgtttggtttctattcttccacaggccccaccatcaggttccgcacagagtgaacactcaaatgttgagggctgataaatgtgagtagcaactactaaatgaaggagatgaatatgcttttgtatagtaacttcaacgatgctttgatatagaaattagtttacctagtgtactgatgaggtacatgaggctcagagaggctaagaaacttgcctggcgtcacacagctagtaagcagcaaaaacagacattcatgttccatacacaatgccttcctggtcagtgacactttagcagactatctagagttctggcatcgtataaaccaggcattatccacatatgtatattttaaaacctcactgaaagcagaaggataagatgaattgactttaagcattcctggggaacaaaaagtcaaaatggaaaaggagaacaggagcataagaaaaaaatatatagcataactcgttatcccttagataactgtagggtcatgctgatattagtcattgtactgtgatgacaccaaaaagggaaagtgtaccagctagccaggtagatgcaattcattgtgcaagaaaaggctgcctcaaatgtgtctaaaagcgtggttcttcattcagccaagtcaagaccaaaggagcacatgaataattggctacagctcccctttcagcaagtaccagctttctctgctgaggctgatacagctccatacctcagggggccgggaatcagctgccagcagccaatgggcttctgagcattcataagcagaccaggtgctgatccatcaggctaattagcagcctgtgggccacagttagctgggaaggtggagggttttaactcttttcctgacagactccaagcctatctgggctttttgagcaatgttctatcagtcaaaccacaaagaaaagtattagaattcaaaaggagggaagctaaaaggaaatatagttttgctttaaataagacaagggagactaacaacacaaaggaagtgaactttgactctcaaatatacatatatatagatgtatatatgtgtctgtacgcatctcagtctacgtatcttcatgttactgactgtaatgtcatcaccacagcagacattcaatacatgtttgcttttgttgaggatgatatagtgatatttaaaacagaaataataaacaagggaagaaaataggacaggattgcaagggagggggatatttagcttgttggcacctgaaatgtatttaattatcaggctcccaaaagagcagaggaaacagaattagcttcaatgaaaaatacagagaacatgctgaaagttcagaaaaaatgcaaaacttactttaattaggagatggagatggaatacatcagaaatagtgtcactgcaaattaccagacttataaaccaatatgtaaatcagcagaggaaacaatcccatgaattttagtaaatttgtagaaacttgttgtaaatagtgcatttaaaattagttttaatgtgaaatagaatcaacaatcaatgaagccaacaccatccaaatgtcttcattgacataaaaggagcattctatagtcaattggttctatatttttgactttagtgtggttttgttgatcatggatccaataatctccagtgaagcagtgccaatatatgatctagcgataggaaataacaaacaagcatcctaatccttaaagtagccaaatctgacaatcatagaaaatggcaaggcaggatactggcaaaagtcttaaaacacagaggtaacatttatggagatgtctgcacgggctctctgtcaacatatggagaattgaggaagagctacgggatttcaatgacaagcccatcaccaccatctggagataaaaattctgtggtagattttttttttaaactgtgatattttactgataaattttatattagtgacaagatcctaaccaaagtttccttggactgcttactataaaactgtgtactattgactctggggttaaaaaaatggatttatgcctcactgagaaacagctgtcattgcatttgtagaatcatagtgtcaagatgatgaaactgagctaattccagagtcttcagggacctaaagaaagcattatacagccctgaggaggtttgggtgtactggcagtaatgtcaactgtatggccctgagaaactaatctccatgttgagattatgaacacaaatctttccccaaatatttactgagtaaaaacatagtgagtggtccattagggagagcaggagcatgagttggattgtttttgttctaagaaatgaatgcactaccttggactataatcaatttggggattgtggtcttttaaacagaccatagcagatgattcagtgtcagtgggccactggattcatgccaagtgataattctccataacgcttcctacagtctggtgtgtgcaaaacaggcaaggtcacaagtctgttctacagccaccgggtgtgctggtccttttattgtcctggcaaagtaacaaccctgtgtatgcacccctacaaactatctccccatggtttggtcagagctgacccccaagctcaccctgcctaagtcatttattactagcagaggaagaaataagcatataatcatgaccttatctacttctctagcctcaaatctagtctctcctcaatcaaaccctttcctatccctcagggacaccttgactgggtgcctttgcctgtgggactctctgcccttagcatctttcaattagttctctgcctggaaggctgttcttctttcatgtgttacctcctcctgaaatggtttcttgataataacagcaaacacataggatttgcttcataccaggcgcacttctaaatgctttattaaatgtacttacttctcaccagaaccctttgaaataggtactgttatagtctctactttagatataaagaaacttaaaggcagagttgttaagaaatttactcagggtcactggtaaatggtagagctgaggttatgaaccatggcagcctggctccagagtgtctgttcttcatcacgactctgagcataatgatccctagactttgctgttagtatcctgagcactcgctaccagagaagtagctgcactgcactctagtcatgtttgtaagcttcctctctttccatgctaactccagttaatccaacaacactcagccaaagcatcaactttttcccccttaagtcttcctgatcctgctcccctaacctgtgggaggtgaatcctccactgcccacaccatgcttctctctgctagactccttatcacaccacgtgtcttgtttacctgtctgcctccctcattaatctgtgaactctgaagttttgaaggcacgaatggtctcagtaacacagtatctggcatatagaactgttgcttaataaatatttgtctgtttgatggatggagactggtgctaacaagtcttcattttgcaactctggtttctagcttttaccggcagattaagaacaaaagggattccatcacaaatcctgggagaatcatgacaaatgcttagcttcagttcagaaagaagcaagactatttatagctcagggactcaacattaaatgacccggacttaatttttccttgtgacctagatttgcacaactttagatggaaagtgcccttggagatcattttacccaggtattgcaaactggtggcctagagttgtttttatttgacatatattatttgtttctatttttattagaatacctttagacaggacatgtgctttttatttctccacattttacatcatatcctatcatacaccactttactcatttgtattatccacctgaccattcaaagcatttgaatatgaaatgtctgaattagtctaactcattttttttggtctttgtttacagtaaagctcccaagtctgtacttagggtctccaattttctcattaattcattccagtcagatgttctcccaccctctactgatgtgtagactgatttccatgtaacaatgtaccaatcatgtaccagtgatttccacctagctaaatccagttcctagcttggacctcaacccctcctccttgacattcaggaccatactctcctggttttcctcctacttctctggcctccccttctctgtcttcttgctgattcctcctcatactctcgacctctaaatgttggatcctccaaggtgcagctcgtggcctgcttctcttctggatctactctcatccccttggggatcttgtacaggctcatgagtttaaacactgcccacatgttgacacttcctcagtgtacatctccagctcacttggttgtctagtgggcctgtcaaacttaatatgtctaaaaacaaactgccaatttcttcatattttttttgttgttgttgagatggagtcttgctctgttgcccaggctggagtgcagtggtgcaatctcagctcactacaacttccacctcctgggttaaagtgattctcctgcctcagcctcccgagtagctacgatgacagacgcgtgccactaccacacccatctaatttttgtatttttagtagagacaaggttttgccatgttggccaggctggtcttgaactcttgacctcaggtgatttgcccgccttggcctcccacaaactgtcaatttctaccccaaacctgctcttcttagcagttttctttatgtcagttaggggtatatccgggccaccagttgctcaggccaaaatccatgggcttatctctcattgcttcctttctatgtgatatggtttggatatttttcctcttcaaatatcacgctgaattgtaatccccggtgttggaggtggaatctggtgggaggtgtttggatcatggcggcggatcccttatagacggcttagctctatcctcttggtgatgagtgagccatgagatctggttgattaaaagtatggtacctccccactctctcttgatcctattactatgtgacatgctggctccttgtcaccttttcagccatgattgtaagcttcctgaggcctcaggagaagcacatgccagcaccattcttcctataaagcctgctgaaccatgagccagacaaacctcttttctttataaattacccagcctcaggcatttctttatagcaacacaagaacagtctaacacactttcatatgccatatacaagtcctcagcagtcatgtctactccaatcttccagtgcctcccttgttctttaagagtaaaagccaaagaaagtccttagagtggtctctaggagccttgatattctaccttccttccttattcctatccctacctttatttctcagacccccattcccaccactatcccccttattgacctgcctccagctcactggcctcccttcactgttgagtgaacactccaggcatttttctacatcggggtgtttgcatttgctgttccttctgcctggaatacccccacccttcccttccccatccccaggtatctgcatgtatctgcatgggttgcttcctcatttccttcatgactactcaaatgaacctcctcactgaagctttccttgaccactctatttgaaatagacttccctaagccaggatgatttttcatccctcctttctgcttttctctagagcactttattaccctctaatatcctatatattttacttacctattttgtttctcttcctactagaatgtaagctaaatgagggcaggcttgtttgtcttctttgtttactgctacatcctcagcatcagaataaggctgagaacttgttatgggttgaattatgttccccccaccacccccagtaagtcccagtgaccttatttgggaacgaggtcattacagatgtaattagttaagatgaggtcacactggagcaggctggacccctaatccaatatgactagcgtccttctagaaagaatggcatgtgaagagaaggagatatccatagagggaagatgatgtgaagatgtacagggagaagatggccatctacaagccaaggagagagatctggagcagatctttcagacttgatttcagacttctaagacttctagcctccagaactgtgagacagaatttttttttagacagagtctcactctgttgcccaggcaggagtacagtggtgtgatctcagcttactgcaacctccgcctcccaggttcaagcgatcctcctgcctcagtgccctgagtagctgggactacaggcatgtatcatcacacccagctaattttttgcatatttagtagggacgggctttcaccatgctggccaggctgatctcgaactcctgatctcaagtgatccacctgccttggcctctcatagtgctgggattacaggcatgagccatcgtgcctggccaagacaatacatttctattgtttggaccaacctgggtgtgttactttatcactacagccctagcaaactaatactcaaaaaaattctcaagaaaaatgtatgggtgaataaacaagtgaattaatcctttcaatgaagaaactgaaggccagtgaagttgattaacttgccagaaacacaccatggtgaacgggcagaaccaagactcaaatccagctttcctgccgccccatctagctctcagccaccacatctggatgccacgtcagtctgtctcatgagcactaacaatggtgggctgaggttgagggggatctccggagccccttcaccatctcctaggtcttgcctatcctgccttcctgcttaacgctcccaccaccatcacataacctggatatgttgtggccagacaattattgacgtatgtttgttaagtgttctgatctcctctcagaggaaaaccctgtgtttgactcttctattattcaggaagtaataaaagttatagtcataatatataagaaaaaagaatgattcactgctgagctactgagctacagggagcaatccaaggtttagaacagacaattggctaagatcagtcacgatgatgtcacagcggaatatacaaatacctcagtgggctgatccaagagaacatcacaattaaatcagcttactgctgagcactcttccacatctgtgaagagctgctctccattctgacagccacgtttaaggaggtggtggaggcggcagtctatccaacaccctccacacaggaagaaaggattgcaaagtgctactgagtaaatgaacatcattcacatggaaatgcactggacgagatcatacatgttaagacagttaacagacaggttaggaacaatgttttcttttcagaatggaattacagtatgacattgggcatgggaaactgatgagagccatcagagatgatattcaaaatgtttaacaaaatatcgacagcataagccatcaatggccaatgcagccttatcaatgcagagtggttgaacatggtgctggtgaaactcacttggctagaatagcagagatgccattaacctctctgacccttagtttagtttcttcattgcagagtgaggcaccaccacttatttcctagtgttgttacaaaggttaagaaaaaaatctgtgccacaattcctggtacatatcagatccccaataataagagcaaacatttatgtgtctttattatatataaggtattagcaaatgctaatttacttaacccttatagcagccctagtattcaactattttttttttttttttgagacaggatctcactctgtcaccctggctggagtgcagtggcacaatcacagctcactgcagcctccacctcccgggctcaagtggtcctcctgtctcagcttcctaagtagctggtgctacagatgtataccaccatgcccagttaatttttaaatttttcgtagagacagggtctcactatgccacccaggctggtcaagaactcctgggctcaagcaattattattagcattttcccgttggagaaattgatatagagagcggttaagcaactttctcaatgtcacactgctggtgaatggcaagacagggtcttaggacccaggtagaatgaatcccaggggctccttccccaccctatgctaccctcaggaaatgtcggggcccatccctcccactttatgctccagagagccagtgtccctgcaaacctaacatctcattgcctcaaagtcccagctaaagcctagtggagaggacatcactctttggtccttcagtgccctagcccttctttctaggtttactcaatttccatttgcatgaagacagacaagaaaaacagtccaattaatacgaagcgtaagaccacaagatgagaaggcttttgctttgctttttattttgtatcagctgaagtgctgtgagtattcgggatgaaaaattatttatcccagttaatgaatctcatgataataaaaatgcctgacagctctgagattagtgagtagcccttatctggggaccacttagtgaagcaaatcctgcgtgaacaaaggacaaatgggatttgggagaatgaggaggaagggaggctaagaacgaacatgtgttttgcagctatctcatgccaggcatcacacaaggtactcaaccctcattctttcttttaattcttttgagaactcagtctttatacaaacacttatggcagtgccaggtaccataataagtgttggggttacaaaattaaataaatcatggcccctgtccttttaagtagaatggatacagaaaataagtagagaggctatttatgttcactgcaatattagtttgatatgagtatacacaggcagtggaactatgctatacaggccaagatgatacctaccatgtcaatagttcctgcataaggactatttcctgcatacgcagctgtgttctgggctgggtgatatacccctgcacctccccatggcccctcaggcccttcacggaggttagttggctagaggagtgagattctcttaggagtttacacttggaagcagaaagagaatcaggcaattggttgtgggaacagaaactgagaagatgatctaaaaggagtgatgaagtacagtagaatggggctgggtgggaccatgtgtaagcggaagctatgaatacacagaagatacaaggcacagaaaacgctgagcagaatgtgaggaagctaggtcgtagcaggaaatgaatagaagcagaggatactctaaccaacgtatgccccacaatttaatcctttccctaatgttagatcattctcattttttcctgtattacaaggaatcctatgatgaatatcattgcacatcagtatttgtagcatttctgatgagtttctctaatatattcttggattaaatggtatgcacattttaatgctcttgagacaagtatgcatctttatttccaggaagatagcactaatttcccacgcccttcagtattatatgagtgagtctactttaacacattgtctcacactgagtccttgtcacttaaacagggaacggtagtaactacctttttaattgtttaattatttaatttttaattgtttgcatatttttcatatgttatgggacatttgtatttcctcttttgtgactccagcttgtttatgtctttttgtccatttgcctataaggccatttataatgctcttattgatgtatgagaaatcaataaaatttatataacaagaccaatactcactgacatatttagcaaacacttacccataattagttgttttccttttcatttttatttgaggcacggaagttttatatttttcaatatattgatattttcctttgtaatttgtttcaaagggtttctttttgcggaaaaaaatctttttctgttttctagatcaggaaaatacttggctctgtttcttttcctacttttggaaaatgtttttgcttttatatttaacttttctgttcacttacaatttattttggtgtatttgaacctttatgaaggaagattttgtactaaattaaaaaagaggatggtgtgatcctgtttcagaaaaatctaatctgtgttaatgtttgttccccagcagaatcaaccatggattacttccaatgaccagtgcaatgacttgagcacacacagacccatttaaatacataatgagggagaacatatgatcaagggcggagatgccatcatttgtgctctgtatacaacctacttttattaaatggaaattatggtcactgaataactcaatctacctaaactcttacaaggaatcagaagccctcagttcttaagctgggtctgtactgatttacaatgggacacaaacacactgtacctccttaaccctaacacccactttccaattgcctgtctttcaaaactatctaattagatttctttaaaaagaacatttttgtcatttgtgaggaatttttcttttcttttttagtttgctcttactgaaaaaccaaggcaacttcaactttatcttttcatagggtccctttccaagtgttatgactgaatggaagctgtgtggttggtgaagtacttcggctatatttccaaaaatatgcaattgttaggggctgcaatgcaacagccagttccagagactagcaaaaggcagggggatactctcaagagtgactacactcgagactttccatttcagcaacttcaggaattggggaaaactcactaattcaacactgagttctctgaaagtgatggtgtattagtttgctaggtctaccataacaaagtacagcaaattgggtggcttaaacaacagacatttgttttctcagaactctggaggccagatattcaagatggcagcactggggagaaaatctagcttctggtggtttgcaggcaatctttgacatttctttgcttgcagaaacatgaccacaatatctgtcttactcttcacatggcattctctgtaaagccacactatttgcttagattgtttgaagaaggcactttcagatgtgttccagaggctgggcaccttgatctggatcaaacgctgccaattgttggttgaaggtgagtgtagaaatgtatctacttccaaagccaaaatattactgtattagtccgttttcatgctgctgataaagacatacctgagactgggtaatttatacaggaaaaagggtttaacggacttacagttccacgtggctgggaggcctcacaatcatggtggaaggaaaggaggagcaagtcacatcttatgtggatagcagcaggcaaagagagagcttgtgcaggaaaactccaccttataaagccatcagatcttgtgacatttattcactatcacgagaacagcacgggaaggacctgcacccatgattcagttacctcccacctggtccctcccacaacatgtgggaattcaagatgagatttgggtggggacacagccaaaccatatcaattactaagtacacagaaaaatttataagtcttggtccatgtacctcatcaacttcttctagcaagaagcagctggctgacttgcaatgaaatctccttagagttttatctttaaatcattgatctcaatggatatcttatacctgaaaatttgctgttttactaagggtgaagtaaattaaattccacaagagttagaaaataatttaatcagctggcaaaagctaaggatgaaagcaagttaatacaaatttcaattttcaaacaagattcaatacatgtatataatttatttggctagattcaatacatgtatataatttatttggctattacagggagagaaaacataattactaggtcttattaaaagtatgtctttcttcttttccctgtcatcctttcttccctttcttctttcatttttaaattcccttcccctcttcctcattccttcctcctttcttttcttcttccctcccttgatgttttccatttactcagaaaacatttagggagcaattaccacaagttagagtatacaccatatgccaaggatgcacccaaaatgtacaggtgataaagcagcagttcctgccctcagcaagttcatagcctaatagaatctgagttatgtaagggtgaaggccctacagtacattctctataatattgtagtaagaggaataatctcagatctcatgcatgcattccatgatttttctctttacttttgccactgtttttctacctgatattaatcttaatactataatcttatactactccttcaagcagctccgtgtgttttctataggcccaccaattattgccatgttctaataaggttttaaagaaaatatgtgaccctttagaacatcaccccacttccatgcctgtcttccatcctctgtataaagagcagagggtgtgaagaatggactagaagggttcctgggtggctcattgttgtgatctgtttgcctgctttggcatgctttgattataataaatatcttctctgaggggagcattttgaggaaagtgattgtaaaagaagatggaaatccatctataaagatggtaaccacaggaactaatttgaagaggtttttcatatttattaatagcatagaattgtccttccagaaagcataaagttctaaatttgaacaaagtccacagtctgaaccaaaattctgtacctttcagaatggatcataaaagaaaaaaagtctacagcacaaaaatagtttcctcctataacctcaaacaaatgtgagggcgatctgcccttgcaattttcattacttcaagataacaacaaggaaactatgattcagttagttctttcctttcacacattcagagttactctgcaattgctgagtgctagtgtatctatcctcaagtggcatttctgtttgagaactgtatttttcattatttagagttttctgtaatttttactggtaatattaatatttaacaatatcatacccccagaggtatctttgtgcaactttagaatatacgtactttgtttctttttatgactctaaccttttattctttcattcctctagtactctgaatataagagagtctacacgctttttagtgaggattttttgatccctgcttcataagtgtcactcattgtaggctttcctttgacaacaaaaattcctgctctctttacgttgactctaattacttcaccagaaaaggtaaacctgtcattgtgtaagaaaaggaattaagttaatgtaactgtttcttaaggtcttattattattttatttttatttttttgagacagagtcttgctgtgtggcccaggctggagtgcagtggcacaatctcggctcactgcaacctctgcctcctgggttcaagcgattctcctgcctcagcctcccgagtagctggaattataggcatgcaccaccacgcctggctaatttttctatttttagtagagatggggtttcaccatgttggccaggctggtcttgaactcccgacctcaggcgatccacccacctcagcctcccaaagtgctgggatgacaggcatgagccactgtgcctggctcttaagggcttaatgtgaatgttgcatacacatgtaatttctgattcatttgtggacctttgcgtaaaaataaaattttcttagaaattcatagaaaaacatggcagttcttaccatgcatcacagtcaatttcctgagggttctgttctttggagtctggggaggggaggtgctgtggtttggatgtgtttttttcccaccaaagcccatggtgaaattcaatcctcagtgtggcagtgtggggagatagggcctagtgagaggtgtctgggtcatagaggtatatccctcatgaatagattaatgccttcctgctagggtgagtgagttctagctctcaggggaatgggttagttcccttgaaagtgagaatgggttgttaaaaggagtctggcttccttggttttgctcttttgcttcctttctcagcctgtgatctctgcacactttggctctctgtcactttccaccatcagtagaagcagcatgaggccctcaccagacacagctgcctaagcttggggtttccaggatcatgagccaaataaacctcttttctttataaactacccgtctcaggtagtctgttctagcaacataaaacagactaagacagaggtcttcaataccaaaagatagtctacttgatgtgtgaagggaggctttggtttgcctgctataaaataattttagttgatgaacccgaagttccctgaaggtttagtttctggtgactttcattctgcaattcttgcacaaatggaaaaaaatccatcctagttgaatggagtacctacactacaaatgtagagtgaatctgtagaaaccactttttagataactgataaaccagctagttgctaatcacttcattgctgcttcccaccaccagtcaatgtttaaaaaaaataaagaattctccacctaactttgacaactggggaaaggtaggactttgtttcagcatcaaaaggaagtagagccacgtagaattatcatttagttccctcagtcatagccatttctcatttttcatcttccctacttttctcagggccatttattgtcctctaatgcctcccttctcttcattcttttttgctcttaatatctctggagggacaccaaagaagtgatttctttctgcattcattaaaaataggtttatgttttgccttcctgttcaattcccacttgggctgtaagcaagtaactaaagcaagggaagggttgggcatgtgggcgccagacttagatgcctctatttatgcctagattcttcctatttctcccattcttccctcaggataggagaaaaaggaggtggcagaggtctgattaaagcagggatgagcaactgagccaccactgcagtgctgagattgggtgaagcccccagcttcacagaaaggcctgcaacatcattgcaagattaaatgtgccaatattcttgctaagttactactttttgcacattaccagagaatagacttcccgggcctaaaggaatggcaatgttttcattgtcatttatttctctgttcagtaaggtagatagtacaggttttaagagtcttcttttttttcctcatgagactctatttcttttcccctctattttcttctatgctaaatggctgtatctactcttgaaaatacattctaactctaagtgtcctttgtggatttgactttaggaaaccaaagtagcttcccccaagccaccctctgtctctcttttttgtttttttgcccattggtcgattttaccttctttttgtataccatcaacccaaagacacagcatactagggacgtaagtgtggaactgataccgttagttttatttcggggtgatgcaatccctctgctaattcttagatggtcttatggtgtcagaagaaaatttccttctgtcagaaagccttaagtacgtttggaaaataattcagaatcaaggctgtcttcttctgttttttaatcaattcactaaatagtcttcatcatacagagaaattattccttctactccactccaaactaagacattattttgaaatagattatcaaataatagtgcagactaatttccatagctcaatgagtagaaggcaaagtacattatttgctaatgcaaatgctgagccttctccaaaaaatttaatattcaaagtccagacgggataaggagacaaaaaaagattgcttaacaattttccaaaccaaagtgacctataacacacaaaatatggttctattatgtgcaactgatattttctttgttgagaataatgagctacagcagaatggcataatgtagaactccacagctgataagctttctgcataagaacaggaagaggacatttcttaaagagttctgtgttcattgcttaccttgaggaggcagtgaatggaattactgttaatagtaacaatatgaagctaattggtttaaaatgaagcagcaggaaatgctgatgatgagactggggtatatgaaggaagaatgaaaaatctatactccggctacacaaaaatgatgcttaaaatgtaacttaatcttgatattttattcataaatgacaaatctgctcactacactgattccctaggtgactcatcaaatcccatctctaggtttatgaatctcaaaattttgtagctagttctgactgttttcactggcaaaatttgtcaaaatcaacttcttaagaatttggaaattaacccaaagtttgcaataatacaaaaagcatttacttttttaaaaaatggctgaatcccagtaaaaacagtgagctttgtggcattttaacttgcacttataaccatctgcctctccacagcttcacagtatccttgaaaatcaacagctttgcagccatgatagctatgaaaactagcagcctagcagccactggaggggacaggtcaggtatgaagctcccccaaaattcccattcccagagaatggtcactatttaacctgtctgaaagttccttaagaaagctccattcttatagtttgtctttatttgccttgacttaaagctcatttggtgggaatagccctgaccccagctaattttttgaaataatcagcaaaaaagctttcagaatagtgacactaattgaaactaaaaaaagaatgaccaaaaatttcacaggaaagactggataatgagatgtgtttaggggggtttgaaaagctctgatagatttctggtaatctagaaggccatgcacatatacagggctgtgcacgttcccagaaaagacctgagaagcccctattctctcatctctagttgactttgaggttctgtgcaagctggatgtgaaggctaaggcagagttgtaaactgcctggtagagcattgaagacacaccttaatacacacacatagtcctttggcagtggctgggagacttactggctcaaggcatttaaggaaatctgttcaatcattaggtaattggtaagctaactgagcacagacttctgtggatgcagtgagagataacacagaatttacagaattagtccaggaaagtcactaaacaaacagcagctgcaataataaagggcatcaacaacagaccttagagaggagggaggaatatgaattccagaattgccacactatattccttaaaatgtatagcattcaacaagaagttaggagacatgtaaataaaaagcaaagtatggcccatacacaggaaaaaaggaagtcaatagaaactgtccatggatgttggacttcctagacgaagactttaaaccatctatcataaatatgttcaagttactataggagacatgtctaaagaattaagggaaagtatgaaaataacgttttggcaaatagagaatgttaacaaaggatataaatgatttaaacgtacaaaatcggaattgtggagctgagcagtgtaatagctgtgataaaaatatagtggggctcaacagaagaaagaataagcaaacttgaataaaggccaattgagatgaataaatagaagaacagaggaaaaaagaatgaagaaaaacagtatcaaagacctgtgcagtgccatcaaatgtaacaacacatgcatagtgagagtcccagacagataagagaaaaaaaggggatgaagaatatttgaagaaataacagctgggaactctccaaacttgatgaaaactattaatccacacatgcaagaagcccagtgaactccaagtagggcaaactcaaagagatccttactttactacattacagccaaactttctacagctaaagacaaaaagagaatcttgagaatgccaagagaaaagtgactcattgagttcaagggatcctaaataacattaacagccagcttctcaacaaaaaccatgaaatccagaagaaaaaggaatgacctattcaaagtgccaagaattttacatccagcaaaaccaccagttaaaaacaaaggagaaattaagacatcctcagataaactgagggaatcttatcactagcagatcttgctccacagcagatagtaaggggaaaccttccgggggaaatgaaaggatgctggacagtaactcaaatccacatgaaaaaataaagagtaccagtacaagtaactgcatttgtaaatataaaagacaatataaacacatttttgcttgtaactctttctaatttaaaagacgaatgcaaagcaatgatgacaagctgtttgataggcttataatttataaatatatacttttttaattgaaatttttttcttttatcatccagcccaaaatgtcataaagatataatttctatgacaataataacacaaaggaggagaaagggaatgaagctatattgaagcagttttacatataattgacggtaaattggtattaatccaaactagattattttaagttaagatgttaattgtaatctctaaggcaaccactaagaaaataaagatatagtaagagaaacaagaaaattaaaatagtatactagaaaatttatatgttaaaaagaagaaaacctcaagtcaataactaaaacacacctcaaggcactggaaaaagaagagcaaattaaacctaaagcaagaagaagaaaggaaataataaaaataagagtagaaataaataatttagagaacagtaaaacaatagaggaaatcaacaaaaccaaaagtgtattctttgaaaagatcaagaaagttaaattaacaaatctttacctagactgaccaagaaaaaaaaaagactcgaatttcaaattattaaaattaggactgtaagaggggatattggctgtgcagaaataaaacaaaagattataagggaatgccatgaacaactgtatgccaacaaattaaataatcttggtgaactgaacaaatacctaaaaaaccacaaactgttgaaaccaactcaagaaaaattcaaaaatcttaatataacaaggatagagattggattcgtaattaaaaaaaaaaaacttcccacaaagagaagtctaggccaaaatggccttattaatgaattctaccaaatacttaaagaattaacaccaatttcataagttctaccaaaaaatagaaagggaaggaatacttctgaactgattctatgaggccagtatacactgacaccataatgagacaatgacatcacaagaaaataaaattaaagatcaatatatcttatgcatattgatgcaacaattctctagaaaatatcagcaatctgaatccagaaacatattaaaagaattataaccatgatcaagtgggatgcatcctgggaatgcaagatgtatttaacatacaaacataaatcataaatcaatgcaatactttaaattaatatataaaatgacaaaaattacgttatgagcacaatagatgcaggaatctcctttaacacagcccaatactcttttatgataaaaatcattcaacaaaccaggaaaaaaacacagaacttcctcaatctgataaagcccagccatatatagaacccatacggctaaaataatacttaatggcgaaagaccagatgtttttccctttcccaagacaaagctagctactctggtcacttctattcaatatagtattgggggtgctagccaggctaattaggcaagaaaaagaaatcaatgcatctagcttgaaaaggaagaagtgaaactatctctatttgcagattacgtgatcgttatatagaaaaccctaatacacacacacacacacacacacacacacacaagttcagcgaggtttcctgatacaagatcaatacacaagcattagttgtatttctgtgtattgacaatgaacaatttggaagtgaaattaagacaaaaattccttatagaatagtatcaaaaagaaaatgcctagtaatagatttaaaaaagaaatgcaatactttcacactgaaaactaaaatatcattgcaagaagttaaagaaaaactaaataaatggaaagaaaactcatgttcatgtatcagaagactgaatacgtgaagatggtaatactcccccaaattgatctacagattcaatccaatacctattagtatctcagctgccttatttgtagaaattaatgagctgatcctaaaattcacatggaaatgcaaaggacccaagatagccacaaaaatcttgagtaagaagaacaaagatgaagaactcatacttcctgatttcaaaacctgatacaaagctacagttatcaagacagtataaagcataagaacagtattggtataaggagagacatataaatcaatgaaaataatttatattttcagtagttcagtagcaggcttttacagggttaactgattttcagtaagagtgccaaggtaatccaatggaggggaaacaggctcttcaacaaaagttctggacaactgaatatccacattcaaaggaatgaagttgtaccagctcacatgattcacaaaaattaactcaaaatgaatcataggcctaaatgaaaatgctaacactataaaactcagaagaaaacatagaagaaaatcttcagaatcttggatcaggcatgacttcttagcaatgacactgaaagcacaagtgacacaagaaaaaatatataatggacatcatcaaaattaaaaactttttgtgattcaaatgatattatgaagaaagtaaaaatacaatccacaaaaatggagaaaatatttgtaaatcaaatatctgataagggttttctattccaggtatataattaattgttatagctcaacaataaaagataagtgacccaattttaaaatgggcaaaagatttgaatagacatttctccaaaaaatatatgcaaataaccaataaacacatgaaaagttacacagcctcactagtcatcagggaaatgcaaataaaaaccacaatgaaataccacttcattcctactaagatggctaaaataaaaaagaccataacaaatgctgacaaaggtgtggagaaattgtaactctcatatgttactggtgggattataaaatggtgaagccactttggaaaacagttcagcagttcctcagaaagttaaatttagagttaccatatgatccagcaattccactcctaggtatacacccaagagaattgaaaacatatgtggatacaaaatttgtacataaatgtttctagcagcattattaaaaatagccccaaagtctaaacaattcaaatgtccatgaaatgatgaatggatacataactgtggtgtatctatatgatgggataaaaatttgtcaataaaatgaagtacttatacatactataatctggtgaaccttgaaaacactctaattgaaaaaaactaatgaaaaaaagaccacatattgtacgattctgtttatatgaaatgtccagtgtaggggctggggaaagtgggggcggggtagtgactgctcatggttatggggtgtcttttggggatggtgagaatgttctaaagttaagacagttgtgatggtcacacaactctgtgagtacacgaaaaccactgaattgtacatattaaaggagcaaatttaatggtgtgtgaattatatctcaataaaaaataatgtggtgtaaatctggccactcatggttttcacctcccttttttttttctcccctattgggacaattcataagttaccatgctgctggcagctctggcagaaaatgatggtgacagaaaatgacatttcaggaatggcttttaaggcacgaggagcaatagcctgaggataatcagagttgttaggctactctcctgtcctggaaagtgaaatcaacctgattctgtccatcatggacactggtgacttgagttgttgacgaatgttctgtaaagtttaatatcccctgctacactttaaatacagagcccaatccaccatatctttcaaactcaggctatttcaaacataactgaagtagaacttcaaattagagaaacttgaggccttctgatcactggccagaggggaaaaattgttttttatgacctgaaaatgtatttagtatgaaaagaaaatgacttcttaagatgagaataagaaaggggggaaataaccaaatttgaagttctaggtaaatacaataaggcaactgaatagacactcctttctcctgttttctattaggattataattggggattctatctccatccaatagtgtttctgtacacttcaaaggtaggctaactatttaaaccagagacagaacactctgtattactctttttatattgatgtcctgttacaaccatgttttgtttcgttttgtactagagaaaaaagaggactcaaacttatgttgtcaaatatttcctagacacttttgtgtgtgacaggaaggaaacttgttaatactgctgtctcaggtaatactgcttttttagttaatactgcccttcatccctgtgtttaccccctcgagcttatcctccctgttatctgattggtttgtcaacattctgaaccaaaactctattttttaatggaaagcctaaggaggcactttttcctgaaagagattggtgtccctgattatacttactcagagccttctctggattactgggaaggaacacacctgtgcatttgatcttaacaagctctaaatctatattgtgttgctcaggggttgcctgacagagctcagtcccatggtggaagaaacctaccaacctcggtcttctcagctttcaaaggcgacacctgcctctggcctctctctgcattctccccattatgatgtggttctccagaccagggaagagaccagggggaaacacaaactaacacaacaagctccttctggttctgtgtgtagctctttgcaatttccctgctctggtaggcagcactttccaatcagccctgcagctccacctctgagaattcttcatgaggaacaagctttctttagtcatagtcacttgtataagaagagatgttttccttcatgagttgtttgaaatgcagtacagtcattccttgtgttctgaaaagctcccactaaatgacatcatttaattccaggatgctcagaatacttaataatacctttggttttgtctttgcaaaacaagttttgtgtttgtggaagggaacaaatctgaggagtggcaagcggcgaagaccaaaagcttatctgtgtggaattgctgctgtagacaagaacaatataatcctccctgttctgtacctactaaatcttacaaagggttagaaaaatagtatttcatctgtctttgggtttttgataataccaaataacatcaaatggaagcagtctcatggtttcttcattgctaaactaattgttattacatacttgttcctgtgtgatgttaatatatattcctggaaccagaaaggtctacatggtcaaataaatttgaaacttgcattaaataagaataaattgatttttttctccttcagggtttcacagaatctttaataccaatgtgcttttttgaacctcttaatgcagctctggtaggctgactttctgtgtgtgtgtgattattttatttactgccaatctccttaaagttagtttttatttaaaaattatttgtataaacacctgaactatttgactttttaaaaattccattctattgtgttaatagcacttaacatgcgatctacctctgtaaaccatttttaagtgtacattattgttgactgtaaggacaatgtggcacagtagacctctagagcatatttatcttggttgactgaaactttatggctgttgattagtaactccccatttagtaactccccaattagtaactctccctagccctggaaaccacaattgcactctttgattctatgagtttgacaatttcagatgccttacacaagtagcattatgtagtatttgaatttctgcgactaacttacttcacttagcataatgtcctcaaggttcatctgtgttgtcacatattgcagagtttccttctttttaaagactgaatagtattccattgtatgcaactgtgtatgcatacaccacattttctttatccatttgttgatggatatttaggttgtttctatgtcttggctgtagtgaatagtgctgctgtgaatataagagtgctaatacctctttagatcctgatttcaattttggtgggggatacatacccagaagtagattgctggatcatgtggtagacatatgtttgttttttttaagaaacatctatactgcttttcatagcagctataccattttacgttcccaccaacagtgtggagcggtctcaatttctccacattcttgacatttggtgtctttttaaaaaaataatactcatccagacaggtgtgaggtgagctctcatagtgcttttgacttgcatttccctgatgattagtgatgttaagtattttctcatatacctgttgtcatttgcatgtcctctttggagaaatgtctattcaagtccttagcccattaaaaaaaatcatgttactaggtttttttttcttttttactattgagtagtaggaattccttgtataggttggagaataacctcgtatctgatatatggtttgcaaatattttgtcccattcagtaagttgccttttcactcagttgactgtttcttttgttgtgcatgaactttttattttgatgtagtcctacttatttttgtttttgttccctgtgccttttgtgtcatacccatgaaatcatggccaagacgactgtcaagtggtttttcatgtatgttttcttctagcaggtttacagtttcagatctttaaatgtaaaataataatattgaattgatattttgtgtatgccataaggtccagtttcattgctttgtatgtcacgtccagtcttctcaatatcattagttgaagagactatcctttcccattgtgtattcttggcaccgtttgtgatgaccagttgaccatgtatgcatggatttatttctgggctctttattctactccattagcctatatgtctgtttttatgccagtatcatactattttgattactgtggctttgtgatatatattgaaataggacgtgtgaggcctccagcttttttcttctttctcaagattgacttggctaagaattttagcattttgtctatttatgtaaaaaaatgccattggaactttgataggaattgcatttaatctgtagattgctttgagaagtatgaacatttcaataatattagatcttccaatccatgaacatttgatatcttttcatttgtttgtttcttgttttatttctttttactatattttgtagttttcagtctgctttcaacttcttagttgagtttatttctagatattttatttttttggtgctattgtaaatagaatttttttcctaatttcttttttcagatagttcattgttagtgtatagaaatgcaagtaatttttatatattgatttggtatatatcaatatataccaactttactgaattcattttttagttctaacagttttttttttaaatggagtctttagaattttcaaatatataagatcatgtcatctgcaaacaatgtggacaatttcacttcttccctttcaatttgggcaccttttttccttgcctgactgctctggctaggactcccagtattatgttgaatagaagtggcaagagtaggcattcttgccttgactctaatcttagagaaaaagctttcagtttttcatcattgagtatgaggttggctgtgggctaaccacatatcaccttaattataatatgttgaagtaatttctttctgtttctagtttgttgagagtttttatcatcaaaggatgttgaattttgtcaattgatttttcagcatctattgagatgatcatatgatttttatcttttattctgttaatgtggtgctaattggttttcatatgttgagccatccttgaattctacagataaatcccacttggttatggtgtatgatccttttaatgtgcttttagattcagctttctagtattttgttgaagatttctgcatctatgcatatcagggatattggctgcagttttctcttcttttgtactgtctttatctggctttggtatcagcataatgctggtctcataaaataaatttggaagtattcttccctcttcaagtttttggaagagtttgagaaagatcgacattaattcttctttaaatgtttggtagaactcaccagtgaagtaatttggtcctgggattttctttgttaggaggtttttatgatagacagtcttgcctcttgaatgaatatttatatctcaagaagctagtgttctgtgaaagtttgtgaatgaagttttagattcataccctttaacctaatgtaataattaagagaggagactttggacaaaaagtactggattctatttgtgggtctctaccaattaacttcatttacagaattagcatagtaatacttgctacaaatcgagttgtgaaaatttagtgaaatatatgtatactaacaaacaaaaccccaggcacttaggtggccttaaataaatggtagctattattgtgtataaaaaagttagtttagtcaacaccttttccagcaagaagcaagaatttctttcgtttataataataatttaataaaatttcctaaaatgccttctgcatgatgcaagaatgatgaaattatatgcaatgttcagttcgattttagtggttagcacaatttatggtattttattgtttaggaaagggagagtaaagaacatctattgagagtttatttagtactcataccagtcttagggagtaaaaattatctaaccccacttcactgatgagtatgcttcagtaaattgctaaagttcatggaaagcatattctgtggcaatgttagaattcaaacccaggtcccctgactccaaagccaatgctgtctccatactgccataccaccttctttaaaaatgaacaatttggctgggcatggtggctcatgcctgtaatcccagcactttgggaggctgaggtgggcggatcatgaggtcaagaggttgagaccatcctggccaacatgttgaaacctcgtctctactaaaaatacaaaaattagccgggcgtggtggcagttgcctgtaatcccagctactcaggaggctgaggcaggagaatcacttgaacccaggaggtggaggttgcagtgagccgagatcgcaccactgcactccagcctggtgacagagtgagactctgttaaaaaaaaaaagaacaattaattcttgtgtgtacataatagctctctgttaactaaggctattctattcttcacttgtttcaaataaatatctcccctactagatctcaatacagtggtcttaagtcaatttaatcccagtaatgttttatagtcattttctcagaatttctctcatgttcaggtaaggattacataattgaacacaaaattttatcttgtctaagtacttctgacttcacagggaattgtgataaggagtataactcagtggagatgatgtgggatggtaggtggaatgctggccgtggccttagtagtgatcttagtccttcccctgctttaagtccctgtgtgacccagtgagttactctgtatctttaggtcttagttttcttactatttgctctatctacctcatgggagttctgtgaagagtagattaactcacttttccaactctccctatctgtagttgtctcaaagtggagaatgcatactccagggatgagcaggatggttcattcgggtagaggaggatgacatcaaggaacacttataggtgctttaaaatttgttcttttaaaatttacgtttttagcatatgttttataatgtatggacatagcattacatttatgaaaaccataaacacacaaacatatattggagatatgtgctttttttttaattaataggggtaggtgataaaaatgtcgagggcctggtggcctccaggataaagtccaaattctttagtatggcatttatgtcctctggggaccctccagcttcatttcctcccccattgcttctccttctacttaatgaactgaacatactagtatgttttgtagcttcactgtctttgcttatactactctttttgccagagactcctgaaacctctctcagcctcccaccttccacttgaaagactaatttctcaagactcagcaaaggagttatctcctgaataagccctttcctgaacctctcaggtatgccagatcactccttccttgggcttccactgtactgtacacatgccacctataagctgtgtggaagtgtgcttgtttgatttcatttactagtctgtagatctctgtattactctacactgctataaagatactatctgaaactgggcaatttatgaagaaaagaggtttaattgactcaaagttccaaatggctggggaggcctcaggaaatgtacaatcacagtggaaggtgaagcagaagcaaggcacatcttacatggcagcaggagagagagagagagagagtgcaggggaaactggcaattttaaaccatcagatcttgtgagaactccctcacgatcactagagcagcatgggggaaactgcccccatgatccaatcacctcttaccaggttcttcccttgacatgtggggattacaattcgagatgatatttgggtggggacacagagccaaaccatattaagggcaactgccatggcttcttaaatcttttttgttttagaacctaaaatggtccctggtatgtatttcataaatattgattagctatgcaaatagcaaataagctctgagagtactatagcatgttaaaatctccaggcaaatgttaatagttattattattaacctacgttaaattctcataggtttcagtggaatatctttattaaaaatcttaatcaagtgacgtgagcaaaacaatcctaattgacacctgtagacactggttttcaaccccgggagctttcaaaaatatcagtgcccaggctctgctcataggggttttgattcaattggtatgggatatgggtcaggcatctgtggtttttaaaagctccccagatgattttcatgtgcaggcagggctgagaaccattgtttcaaatgtcatggataggaaaagaaaggtgcttgggaaaacctaaggcagagtgctcttcctgaaaatgcaactgcagttgtgaaagcttctgtctttgtaaggttaagatgtgtccttgggggaagacacacacacacaaattgcagttatttattgagaccagactactaagtcacttcgatgaaaacttgagagcttaagactcgccagcatgggctaagaatagatcacattgcagaaaccagaacagtttcttggaaggaatggctgaagacattgacaaaggctgagcagaggatgaaattgggaagtcacccatcaactatgggggttgggcaacgtgaaaatgtgcttaccatttgcaatgaaatggaaaaggccttggtgagaaggcagtggagattaatgataataagtcatgttgagttttaacaagataacatacaggataacaaaaaggcaaaagtttattaagtcagatcctgattttgcaactaacaccttttttcctccctctctttttcaccttgagactgttacagatagctgagtaaggtgccaaattagactcgaactgcatctcagggtgaaaactgtgagtgagcatcagctaatgttatcctaaagtgtatggaattacaagtttctatgaagatgtttttgagaaaccttattaggattagtgcgtatgttgtcaacattggattttctagagaatcagagtgaatatagctggtacataagcattgttaatttgcatcatggatatcaaagccttcttgatagaaattacctatttgcactgcatactaatttgggcattgctgctctggaattgataaaagtttagcctataaattggctgaagttccttttgtgctaagaaagaatttgctaagcagatgcataatgtgccattggccattgcggttaatttttttaagagaataaatatttccaagcacttaagtgccatgtgttacaaatcacaccactcagggactagttgaggcttcttttttccttgaagtcgggcaggcaggacctctagtggcaatggctagttagcagttagatttagtgctaatgttttagaaagtacaaactgcacttcttttaaattctggttgatagacttcaggttgatattccccccaataatttaagctttgcacattctaattccctggtgttcaaattgtcacaagttcttgctgtgtacatatttcttggaggaacacttttaaagaaaatggcttcaaagattcccaggcaaagtggacacctggacctgtaaaaggaacgctgcccctaagatgtggaaagaggccaacaaatgttttaattggttcttgacttcagtactactgactttttctcacatggcacactgatgcccctaaatacccatttgtcctctgaatttggtctttcaaacaagggtgagagatgattttgagagtgagaagagagctgttctactggggaaaagggcacagggagggagttttgacaggtatttgtggtggccacagccagtgataaagcaaacactgcagctgagttcaggccccactgtgaacgggcctgcagttacatctcactcctctcttctgtcagttgggtcccatggggtccactggcaggacccactccaggcaggtgtccctgagcctctcctaaccacctctttctcctccatgtctttgctctctatgtggcgggggcaagaggggagcaaagggcagtagtggcttgtgtgcaggcagccagatgggagcctgaccttgggtcacaggcacacgaaaggcacagcctactgatgcactatttggcctgtgctgtgaggaggggggtgcagagggagagaggaagagagaagaaaactcctttcttctatctctaacctaggcatctagtgcatttcagtcctgaattctttcagggctcagctgaaactgttacttcagaacccttccctgatcaaggtcaggccttccacgggctttttgtagcttcctgtgcttgtctctaccagcacttattattattaccatgaattacttgtgtaaatatttattatctgtgtcagtggatgataagcttcatgagagcagagattggtgtctgtactatttatttttgtattcttatgcaggaggcctgagacaaagtgctaaataaatatttgttgaatgagtgagtgaggcaacaaatgaatcaatgagatacacaagaacatatgtataagaatgttctttggaaataacctagagtctagcaagagggaaacaaatcatggagatccatttgtttgaatatgtcattgaaaggcatatctcaaaaaatatttactaacattgaaaaattctcagaatgtaaggttaagagaaaaaagtagggacacaaaaattgacatatggtatgattcctttttctttttttgacataaagaaaatacagagaattcttactattcatggtagttatattctataaggtcactacaaacactgaattgcaaatactgaatgattgcacctaggggaaatacagagttaggctcctgcaagcctctggtcacaatatttttgtcaactgatcaatttataaccttgttttatatgtgtttctgtttaaagacaccttcttttaatatatattattgattacttaacattgaaatcatgaccaacagcactgtcacttatgcctgaaagaagcttatctaataacacacgtattttctcaagacacatcacagtcttgctatgctttggacaccagacagtgcttcagctccatgctgcaggcgattttaaaccacaagaccactaacaaaaagcatataaatatgaaaaatatagcactaagtagatcttagaaaagatacttgtttacagtatgagagctgaaacaagaaggagaggcatcaccttgtttgacttcgcctgggcatgtatgcatcagccaactcaacctttttgctgctctgagcatgtgcatgcccacaaataactgaaatgcactgtgagtattgatttgcggttacaattcaattttagcaagtaggggaatttgcaaatacaaaatctgtgactaatgaagattgactgtatgtccttaaaacaaaaaaaatctcagggcaaatctgcccctcgtggtagcgggactatggtgacataaacatttaaagatgtatccttttctttaattcctcaaatttctaaaattaacttgtattattgtataagtaggaaaataaatattatttttcttttattaggaaatggcaaaatgtgatgggcagaatatatatagagaaagggtagcaaaaatttctttggccagctgtggcacagtaagtttaaacgtaaacagccaaaactgtcagtagagtagtttcaaaaacatattgagccataactttgaaatatattttgagccgggcacagtggctcacgcctgtaatcccagaactttgggaggctgaggcgggtagattgcaaggtcaagagtttgagactagcctggccaacatggtgaaacctcacctctatcaaaaatacaaaaattagccgggcatggtggtatgtgcctgtaatcccagctactcggaaggctgagacaggagaatcacttgaacccaggaggcagaggttgcagtgagctgagatcgcgccactgtactccagcctgggtgacagagtgagaccctgtcttggtgggaggtgggggagcggggggagggggaagaaaaaaagaaagatattttgaattctctcttatatgacttttgtgaatggccaaagtatcattctgtagtcaggaacaggctgactttttgagccagggcttcaagctgaacaggagaaagagacataagcatgaacaagacctatctctgcaagcagaggtcagccacttgacaaaggcagtgcaaaggggatggctttctccggaaatccctcgcttcagctactcatcctccacctcctgccaagtctaggttaggttcccctcagcagaatgtccttctctgttctagcactccccacactgtgttgtcattacctgtatatgtctgtgttcccaactagactttaagctctatgagggcaagggctgaatgtagcttgctcactattgaattacattgcctgacacattgctttgcacgcagtgagggtgaagtaaatatttgttcaatatataacggaatgattatgcatcaaacaccccaactgatagcgactcctgtgagaatcgtcctctttaaatataagtcggtgtcagaaacaacgccaaacctcaaaaaagaatattgaagagttcaaatgagaaaattcaaacaccccaacagacagtgcctcctgtcagaatcgtcctctttaaatacgaagctcagtgtcggaaacaacaccaaatacaagaatagtgaggagttcaaatgagaaaatttcagtcttaaaaaatagacaagatttcatatactcaggcaaaaagagatagaaataagaatctgcctacgtgtgaaaggcaaatacaattcctgtttcctttatcttcttacgattgtacaccctgttcaaccatctttgggcttgtgattactgggtagtacactgctatttcttgaagtgtccataaacacagatagcagagctcaattcctgaaatgtgctcctgtttgataaggtggattggactggatcttgttcagcctttaatctacttccttaagcatctgaggatgttccaaactcaaggctatttcagtacctttgtatttgcaatgtatgatgctttaaaatgataactgtattaactttctatggcctttataacaaattgctgcaaacctaatggcttaaaacattgtaaatttattatcttatagttctatttatcagatatttgcccagatcttactggacaaagattaaggtgttggcagggtacattctcttctggaggctctaggagagagtccatttccttgcatgtttcatctgtagaaggggggctgctttcattgtcttgtgcccaccttcctccatcttcaagaccatcaggctgagttcttcccatgctaccatctctctggttccctcttttcattcccccttccactttcaaagacctttgtgtgattaagcccagcaaaataatccagaataaaaaatcttattttaaggccaaccgtttggcaaccttaattccatctgcaactttaacccacctttgccgtctaccctaatatattcacaaattctggggagtgggatgtagacatctttgggagttgatatagtttggatgtttgactactccaaatctcatgttgaaatgtaatctccagcgttgcaggtaggacctcctgggaggtgttgggttattggggtggatccctcgtgaatggcttagcgccatccccttggtgatgaatgagttctcagtctattagttcacacaaatgggggttgtttaaaagagcctgggctgggcacggtggctcatgcctgtaattccagcactctgggaggccgaggcggttggaacaactgaggtcaggaatttgagaccagcctggccaacatggtgaaactccatctctactacaaatacaaaaactagctgggtgtgggggcacgtgcctgtaatcccagctactggggaggctgaggcaggagaatcgcttgaacccgggaggcagaggttgcagtgagctgagatcacaccattgcactccagcctgggtgacaagagcgaaactccacctcacaaaaaaaaaaaaaaaaaaagcctagcatctctcttgccacatgacacgctggctccttttcaccttctgccatgattgaaagcttcctgaggccctcaccagaagcagatgctggcgccatgcttcctgtatagctttagaaccataagccaaaataaatctcttttcttaataagttactcagcctcaggcattcctttagagcaatgcaaatggaagaacacaggggcaattgctctgcctaccaaaataaatgtacacactattatatatgcatacaaactaggaaatatagtcatttatatttatcaggattcaaaatatcatgtccctatcccaactgtctactgtctgtcccctcactgcccctgaaaaaaagaaaaatatcctaagatgcaaacactcaaaccatggaatgaaatactcttggagataaaaaagtcaaatacttctcttgctatgcggatttaagagaaacatctccacagtatcagttgtgtgggagtttatgtgtaggaatctaactgctcatgagttatctccatgaagtcccgctcacagtatgaatagatgggatcctgttataatctgcttactgtttgccttgcagttgtgcatataaattatgtctaaacccttttcttcttaatcattcttctttcagaaattttgtttatctttctaatttgattagacaaggctctcctatcccccactgcttttttaacagcacagagatagcaggaggattgatcagtgactggagatccacaggggtgataagcttttctgtatatttatgtagaaggcaaaacacagcagaatgagaaatatcagattccagatttcatgtcccatatgtccccatccaaccctgtatcatgcattaaacaaataaaaagtaacagaagggcccagcatgttggcttctgcctataatcccagtactttgggagatcgagatgggcagatcacttgagctcaggagttcgagaccagcctcggcaacatggtgaaaccccatctctacaaaaatacaaaaattaggcgggcgtagtggtgtgcacctgttgccccagctacttgggaggctgaggtagaaggattgcctgagcccggaaggtggagtttgcagtgagctgagattgtgtcaatgcacaccagcctgggcagcagagccagaccctgtctcaacaaacaaacaaaaaaaaaaaaaaaaaaaaaaaaaaaaagggagagagagagaggaaataagtaacagaactagcagcatttcatattccagctaccttttccccatttacaaactcctgagtctgaaacatttgttatatttggttttgagtgaaaccagaatcaataacaaatttgttttgcattcattcctcaatatatttactgcgtgaatatggatcagcagggatggtgtgagactgccacactcaagctgggcgtttgtgcaatccacatcaacacttccaatactctcaagcaaggccaataaatcataaagctcatgtgctactgaattcagcacttcaccatcggcaaaatcaatggagatgcttccagaattttcagttttacagcttcttgaacaaatcttttcccctagtccctctctttgtctgtctggctaaggttgaggcatggacactgggtttgcctcctctccatccaccttctccatccccttttgagaaatgaccacgtggttgaggtcgatcttgtagtcaagccaattgtggtttttccatccctattcccagtgaggcaacttgttgcatgtcattcccctggcaaccaagactggttcagtttgggttgattcgatgctagcagaagttttttggggcttctaggtaaagcgtcctcatccttaagtgaaagtctcaaagagtcatctttccccatcccaaactgattctagaacttctgcaggcatcttattatagatctgatgaagtaactgtcctagaagaatcacagggaggtggagctccttccctatccctgcactcacctctccagttatgcaggaatatatgcattattcttttgtttgtttaatcctgtttgagttggagttttttgttatatttcctcattcattcaacaaataattacaactgtctgctgtgtacaggcactgctttaagcaatgtggattaaaagaacaaaaagggttcctgccttccagtaggaagagtttaaaaagcaaataataaatctaataaatcaggaaactcaacaagaacaagataaagaactagagagtgacaggagctattgggggaaagatgagagcagctgactaattttaaatagggtggtcaggtttcacctcattgaaaaatgtgatttggctcacacttggaatcccagcactttgggaggctgaggcaggaggattgcttgagcctaggagttcaagaccagcctgggaaacatagcgataccttatctctactgaaaaaagcaaaaaagaaagtacaggcatggtggcacacacctgtagtcctagctactcaggaggctgaggcaggaggaccacttgagcccaggagttcgagacggcagtgagctatgattgagccactgcactccagcctgggtgacaaagcaagatcttttctcaaaaaaaaaaaaaaaaaaaaaaaaaaaagtgtgttttgagtagacttttgagtgaatgagcatttgtggatatttggagaagagttttctaggcagaggatactgccaacacaaattccctaagttggaagcttgcttgggaatgtgagaggagaaaggagtggtgggagtgaagtgagggagggcaggggttaacagggagccctgtgggtcttttagcccagtgcagaagcattttgtttggctttgactctgattcaaatggggaaccacagaaggcttttgagtagagtgaaaaagatcactctagctactgtgttgggaaaggattttggagcagtaaaggaaggtgcagggagctgacttagaaggccacagtcccatgccaggctggagatgctgcagcagtggtccagggttgtagtgatgaaggtggtgagcagtggtttggattctggatatgttctgaaggcagagccaacaggatttcctgagtataggggaatgtgggagaaaagcaaggagtcaaggatgactccagctgaaagcaacctaaatcattaactctcaaatttacctgacttgattatcagctatttacaactcatgaatgttacataccatggagaagtccaacccaaacacagggttcacacgcaaaccagtaatttgatattgagggctctacatgttccattaatcacatccccctacttaaaatattttccttggctgccttttaagaataaagttattttccatagtctttgagagttaactcaggtaggaccgaagtgatgaccgttctgtcctctgcagcaacgccattgccctttatccttgttgtgatgtggttttcctgtgtcttctgctgctagatgtgatgacgatatccctcctttgttgatggactcagcatctgtacatgggatattttgactccaattttcctgatgcatcatcctaattgtctggtagttactgactgtcacttaccaaccggtgtgagatattcttcagctcttcatcaggaacagaattacagcctctatctttagaaatgatatatgctgaggattattcatgtttgtaattacaaatctagcagaagtgcaattattaaaaaaaaaacccttggaaaggacattttgttgtataacgcagaacctgctgttagcctcttgtgctggtattacttttgttgctgtaattgccacctgcatttcagttgtaatttaacattatctgtcttctctgtatctttctacctgattgtaattgttaggactcctgccatttattcttaaatactttcttgtctttctgaattactgggctattttctatgattataacctaagaaacagctgcagcaacccttgttgcattgtaaaaacttcagagggctggtttatctctagtttaaaaccagtgaagcaaacagtggggggaccttcggaggtcattcacataaaaccatcattttaagaatgaagaaactgaagcttttgagtgattaactaagttgctcatgatcatttacattcttattgttatgctgtactctggagtagcaagtatggatatatattcagagataggatcttttaagtcctagcactttgcaatttatgctgattaaccaacgacctgccaaacagagctcaagatgggaagggaagcgacactaaatcctttttttgagccagatactgctaggtgctttgtatcatggaccacattgatatgcacaataatctgatgaggtaggaataattatgccaatttctctctctctctctctctctctgtctctcacacacccacacccccccccacacacacacatgctgggatttttgggagattaagcaacaggctcaagagcacacgggtagtaactctcaaatagtaagaactgcttgactttccaccctttctctttctaccaaatcaggaacagaataatggatatcttccaaaggggtgagatatgagcatgagctactttttttttttttttttttttttgagatggagtcttgctctgtcgcccaggctggagtgcagtggcgtgatctcggctcactgcaacctccctctcctgggttcaagggattctcctgcctcagcctcccaagtagctgggactacaggcacgtgccaacacacccagctaattttttgtatttttagtagagtcagggtttcactgtgttagccaggacggtctcgatctcctgacctcgtgatctgcccgccttggcctcccaaagtgctgggattacaggcacgagccaccgcacacggccaggtatgagctacttttaaggcagttggaagcccaaagagcttgggaaaccatgaagactaggcctcacaactgcagttttctcaggcctatgcagctgcctccatccttttgctctgagcaaaactggacctagttaagcaatgttgcccaactgttaaaaaaggaagctcaaaactaggaggtaggatgccagataatttgtttaaatttttgatctttaaaatcttgactctttgagcttgttttgagcctcattggtccaaagtggctcaatctgactgaggaaggggttggaggaggaaggaatgtaaaaatgaaagatcggtgggaaaaggatactgccttaggttgtctgtaggtaaataaaggtttgactctataaaaactctcttcctgaaataatcaagaatgcttcacatcagaagcatcaattaaatggctgccttctttttgttaattctttagtctttagctatttctgctgttgctgcagaggcagagagatggtgaaagaatcaacctcaggaaatagtatggaggtcaagggtcagctaagaggatctactgattttctgatctgcggagctttctgagtgagtctcccttgaattgcaggagggcatccaataggaaacccagtatgcaacaatctcaagagatagcctctagaacactgggattagcattaatccatgaaaatgaggtgctataatgatgatgatgatgagactagaacctatagttacatgcattgtgggaaaggtttgaattgaaaggctgaaggagggagtggttgtcttccaagagggtatgatggtcatgctgaatgaagaatgaagtgaaagaagtcagtgaagatgcattaagaccgtaggtcaggttcaagtagtaactcccaagggttcaaccacataatgacgcattgaaggatgtctattacaatcataagaaacagcaaagtggttgagtatagtggctcatgcctgtaatcccagcactttgggaggccaaggtgggcagatcacttgaggtcaggagttcgagaccagcctggccaacatggtgaaaccccatctctaccaaaaatacaaaaactagcagggcatggtggtgcccgcctgtaatcccagctacttaggaggctgaggcaggagaataacttgaacctgggaggcggatgttgcagtgagttgagattgtgtcactgcactccagcctgggtaacagagtgagactctgtctcaaagaaaagaaagaagaaaagaaacagcagagtgtcccatctgtcctgcgagtcctaaggaaactgattaatggcttcaaaagtttatttctcatcaaaatgaacttgattaattacaaatccagattttttagtcctgccccccaaaagtctgattttaccaatgaaaataacccccaggtaattcctgcaagcagcctcactggaaacatctggggtaggtgaccccaacttctgtcattgtgagtttctgtgtgctacctttcttttttggtttttgtttttaataaacagggtgttgctctcttgcccaagctacggtgcagtggtgcaattatagctcacttcagccttaaactcctgggttcaaggaatcctcctgcattgctgggattacagatgtgagccactgtgtcaggctctctgtgtgttccttctaatagtacttctagaacatctcttatttttttcttttccagctcggagattcttaatttgagtttctggggctcaatgaatagggcccaggggatctacaacccccctgaaattacatgcagaatttcacatatatatgagctatgtgaagagtctcaaaggaatctgtggtttccaaagggtttagaacaattgctccaactgttctatttatctcctttctgccctgacccctggagctggttcacagctttttatcctggccagtcttcctggctttagtggacagtacatttgtctttgactttgaaactttacattaactatgagacatagcgtgaaactttggaaagagaggggatcacttctatgtttctattaaaattaatttcctttggaagaatatgcctgtgacagttttcatagaacactgctgtccccattttaatgagaaacaaaaaaattcatccacgtcaccaatattctattgtgtctcttttctcccagaagccgatctctttgctaaaccatcttcagcacagctccagttgaagtcctttgcttgtctgggtcctttgttgccctcccggtgttctgctgtccacagaatatagccctgactcggtagcctggcatctgtgccctttgcaatctgactacctcctgctgctctcctaattgttccatgttccaagctaactgtgctcctcgccattgcccaagccctgtctgtgccctcttccctctgggcctacaggggatgccctccctctcctctccatctgtcaccgtgtacccttgttcaaggccttcatcccatctctccgtcagccagaaatttcctcttctgtgaacatcaattgtacttggttcatacgggtcttatggcatttgttacatattgatttttgtttgattatgcatgatttgtgtttctcttttttcttattagattccaagacctttcatcacagggcctttgttgatttaactgtgtatctggtcaattgcctgtcacagtacctagcatacaaaaagccctcaataaaatctggtgaatgtatttaaaaacctagatagggctattttaattcagaaaaataaatctgtttgccttttttcctggtaatctaagttgggcagttgcacgagaactgcatataaactgcattcaactcttgataaattagaaaagtcatctgatggcttcattaaaatgtgggctttaaaattatttatgatttcatttttcataacatctttgtgagacttgtagtagtgtagtattccccccgtcttttggatggtgatttcactgaggtgagaggttaaagtgggtcattcaaggccacagagcaggcaggtaacaaaactggcactggaaccttggcctcctggggccacgttagcagagcgtagcattgactgcactaaggatggaatacaaatgtgcttacacattgtcaaatcctgtgggtcaaaaagtttgttttagtgaaagcatcacagataatgaagtatttgaaattttctcttttcaccttttggcatgcaggctcctctctctctgttccctaaataaggacacgtctgtaggtctgatcctcagccctgtctgtctgtgaccttctccagtatccaggaccctcggcgatcaatacctgcctcgtggtttcaatgatcatcactctgctgacttacctaacgtctttgcctatggtgatgacccctgcctgctctccacctcacatctcttgtggtttaccagaagtttccacttagaattctgccatcacttcaaaatccagatatctaaatccaaactcatcatctgctctctgaacaaacttactcctttctcaatctacatttttctaccataattctcctagtcatccaagttcaaaatcattgttatctttaacttcctttatttttttaagagacagcttctcatcccactgcccatgctggagtgaagtggtgcgatcatggctcactatagtttcaaactccggggctcaagtgatcctcctgcctcagcctcccaagtagctaggactacaagcacacatctctgcactcagctattttttttttttttgagacagaatctcactctgttgcccaggctggagtgcagtgctgtgatcttggctcactgcaacctctgcctcctgagttcaaacgattctcctgcctcagcctcctgagtagctgggattagaggtacctgctaccacacacaactaatttttgtatttgtagtagagatggggtttcaccatgttggccaggctggtcttgaactcctgatctcaagtgatccacccaccttggcctcccaaagtgctgggactacaggtgtgagccactgcgctaggcctaatttttaaatttttgtagaaatggggtcttatgttgaccaggctggtcttgaactcctagcttcaagtgatcctcctgtcttggcctcccaaaatgctgaaattacagaaatgagccactatgcctggcctgttattttcagctttttaattggctttgtcttattgatacttccttcaaaatgtttatcatgtccatttgagaatctagagtggtttttttttttttttttttttttttttttgccaaggattacctctttctctagagccctccacctcatgcacattcctttctttctattttcattaccacattgtgatctaggtcttctcttcctcttccttaaatttcactggtgttcattttgttacaggatgaaatccatagtcttcaacctggcatacaaaacctcccacaagctgactccagttgatctttccaactttctagtctaatacttgcctctggtaattttttttccaattcttctgttgactgtcctggaatgcatcttacatggccttgctttggtcctcagtttagttcttttattttccagtttactcctttggatacttctcatcttcaaggtccagctcatgtctcatctttttgatatgaccattcctaattatttaaatccatattctgaagttcttggcccttgttgtctacatctttgctgctcaaagtgtcattaaatgagcagcagcattgtcaccacctggaagatggttagaaatgaatcttggggctctgcctcagacctgctgaattcaaatctgcattttagcatgatccttgaagtgatgcatgaaacacttgtctgtcccatttagatacttagataatactcaatccaaacaccaacttatgtacttatctgcactcctcaagatccttgaaatctgcgaacctgttttatttttctttagtatctctgaaacacaatttcatggtaaagtaggtgcttactaaatagattttagtgtccttctctttctttttctatttaaaggaggaaaaaactcccaagactcctagaaagtgagcatgagctgctatagtttgaatgtaacctcttcaaaattcaggtattgccaatgagatactgttaagaagtgaagcctttaggatgcgattgagccattagggctcctcccttgcaaatggaacaaggtcagcaaaccaataggagtgctaaggtaaatgactgtagaacaaaatggtgtttatgtagcttgatggtacatgtaatttcacaattgcattttgtgtctgaaaaacatatgaggttttgctaagcttagtagagaaatgcctgctttgtggcaatgttgtccattagttaaccagagagaaatatgagaacagatgatgtcactatattcttccactagcctaggttcttaaaagctctaagactacaagtgttatagatgactccagcatgcactcatactgctacttaactttcttcatggaaatgtgtcttattctgtcaacagactaaaagaggggcaaggacatatattatataattttgtatatactcgataatgctcaggacatagagcttcagttccttccctccctccctccctcctgcccaccctccatttctttattcctgcctttcatcctttaagtgtttgttgagtgattgagatcaaatattgatatattgtatctatagaatagaatattctattctagtgctattatatatgctggggataaatcacgcattaaaatgaatgtccttctctttatggaacttgcattccagtggagcaaaaagataaacaaaatcataagaggaatttatacttagaggacgataagtactgcagaaaaagattagagaagagggcttggaattggggaggtatactttaaaataaaaagccagagaagaccacctttgagaacataatttaagaaaagacttgaaggaggtaaattatgtagctatctgagggaagaccttcccagagagtggaacagcaggtacagggctgaggtgggcatgaacagggaagagtaagaacggtcttttgggtttgaagtagaaggagcttgcaggagaatgacaggagagatgaggtcagatattacatctcaataggatctctctggctgcaatattgagaaaagccagaagggggacaaggtggaggtgggaagacgaattagaaggccactgcaataatacagacaggagatggtggtggcttagaccagggaggcagccgtggaagaggtgagaggcagttacattctgcatatattccgagagtacagccaacaggatttgctgaaagattgaatttggcatatgagagacagagaggcatccaggatccaggcatttaagatttttggcctaagcaactagaaagatgcagctgccatcaagtgagatgggggaaggctgcggtggagaagtcttttttagggaagattaggaacttagctttggcaatgttgagtttgacatatcttttagacaagtggagatattgaggaggcagttgaatattggtggaatgaacgaataaccaggatcttaatcaagtgtttaactcccttaaacataaatcaactttttgtctacttcctcataatgtgaagcactttgggatgtgacattggaaatcagactcttctgaccaaggcccaggtctgcctgaattccaggcctagagatctgacaatgtgctggccatcttcccttaaatgttctctagagccacaccatgtctaaaatggaacgcactctctttatcccaagcctggtctccctctttgtgactgtggtgagtgggcaccactaggcatgtaagctggcagtcacacttcattccttccatttcctcatctccatatctaattggtcaccaaatcttaccaaccccacttccaaaccatctctagaacccatctcccccctccgtcttcactgctgcttttttggatttatgctctcattgtctctcacctggattatatgtaaatcttctcctacctggtttcccagtctccaatcgatccttcacatagctcccagagtgattttctaaaatgtaaatgtggccatgttactcttctgcttaaaacatttccaaaggctttcttctgtccataaaacccaaaacttgagtttggcctgcaaggatcatcaagatctggctcctgcttatctcttagatttattatcccccccatcccccccgtcactcctatccattggccagattatactacctgtagttagttaacttattcattcaattttcagatataaataggatgcttcatatgttacaagcactatgctaagctgtgggggatacaaagctagacattgaaaaagcctgaaataaacctggttgtcttccttcctacttacttacagtcgtcatacagtaagctgtggggatacaatgctgcattgtacgcagacttggttcctgccctcatgaaagtatactttctcaatttccatgcctttgctctctgaaccccctgccttgaatttaccaccatctgctcctccctccatctcactgccatgtcctccttctcctaccagctacttaaagaataccatctcaacttttaagaatcagcttacatcattcccttgtattaagctctttactctatctccttttctcttctaaaaatgtttcctccctcaaaaggtatcattgaaaaacttaatagctctagaagtgaggatatctctaaatacattccaggttcagttcagaatattgttttatcttatactagaagatcatagctcaaggaatgggatttccttctttatcccaaaagggaaaaaagcctccttttcctggatttttcccatgctccttgggctccacaagtgggataagcaattgttaacttgctgcagagtgagtgaacccaattgcattggattcacacacagtggatgctccaggattttttttaaatatttatttatttatttatttatttatttatttatttatttatttatttattttgagacggagtctctctctgttgcccaggctggagtgcagtggcgtgatctcggttcactgcaagctccgcctcctgggttcacgccatgctcctgccttagccttctgagtagctgggactacaggtgcccaccaccacatccagttaatttttgtatttttagtagagacgggttttcaccatattggccaggatggtctcaaactcctgaccttgtgatccacctgcctgagcctcccaaagtgctgggattacaggcgtgagctgccatgcccggccttcaggatttttaaatagtaaagcgttaggggtggtgagctgattggtaggggtgctaggaaacttgtcttaaagctaagtttgcatagctagcttacaattttcacttagattaatatacatagatttatagtagcttgtgggggactgataaagatgtgggttaaagattccttttaaagccatcccttaatgctaccactgtacagaaagatggcagagtgactgcctttatagacacctgcccacacttcctaatctgccctcagttgcaactcctagagagtaggcacacagcttagggtggaaaatacatgaaaattcagtacttgtaaatagatgggaggtgggtaatgaggatgagcgacagaagaaaaaaccttctatatttgtctgttctcaccacctaaggggttcttcagaaaaccagtgagctttacgctcaggttgagaaatccttgttacagtcactttaattgcaatctctatttcttctctctttttctttctctctctgtgtctctacacctctccctcaccactttctggatatgcacacatatttacattcagatgattttagaaagctccattggggaataactataaattatgaatatgcaacagcactaaaaccaactattatagtcaaaaatcctgaaataaacctcctggttctcttccttcctacttacttacagtcagcacacagcaatatatcttagagtgaggctaaatggatatctgatactcactcgaatgtgataggcagtcaacaacccagttatcactgttgaagcattttaaggactacttccatgtcactctggctatgataaaaaccatagtctccaaattggtacagtaggatgaaccttccatgacgactggtagcatgtgtttgattacacatatgtatacatacatgtacacacaatacacatacctaaacattataaccagattagtatattccttttgcattgtactgaatactttaaaataatgtttcatcagtgattgtcagagttataaaatcatttgaatatattaataagctataaacattttaattttaaaggataaaatatgctgcacaaaagagccagtacagccactgcttatgtgtttaatttatttaaagagatgcctgttctgttattacttcaaatatagttatatctacatgtaagtgattttaatttgctacaacatttagatgtatcaatgagacatttcataaattaaaattgtatcacgtagggagactatcttgattatgaagctttattaggtgatgattataagtgccttgtttaataattataacagcttaatggctcctgtagttatactttataataaaaatttcacatttaataatatggaaagggatggtacacagtgaactgacaaaaaagtattgattctgaacctttaaattggattcctattgatctgatgtatgaatattttattggtgtaaatgttttcagggttgccagtttctattactgcatgttagcaattttactggctatgtataatggacaaattaaatgccaggatatgggcatatccagcaccccacactgattattttgattcacttatcactatacactactagggccttccctttctctgtcccatctctgttctggaaggtgagccacagacttcttctgtacatgcctcagatacatgacaagccagtgatgggtggtctggcttgttatctggtagaggctgggtgggcatgtgtctcttcctgctaaggcccacagccccttagctaagacttacacatttgctccaaggccagtcatttgggcccgagtacctaatggataataacaggggctctgggattaggtagagcaagatggctgaacaaaagcttcaaccaattgtcctccccacaggaacaccaaactgaacaactatgcacacaaaaaagcaccttcataagaaccaaaaatcagcttaggtaccagcttggccacagtggagtagagcaccaagcaggctcttggggtccctgattccaggcctagctcttagatggcatttctggacttgccctgggccagaacggagcccattgcccttctgggagagtcccagtcctgccagcattcatcacaagctgactgaagagctcttgtgccttgagtgaacactggtggtacccaggaagtactcaccatggacctagggtagtggtgatcacagggagagactcctctgtttgtggaaaggggagggaagagtagaagaactttgtgttgaggtatgtgttccagctcagccacaatcgagtaaggcaccaggtatattcctaaggtttctgactgtaggacctggctcctggatggcacctctggacccacccagggtttggggaattcactgccctgaagggaaggacacaagcctggctggctttgccacctgctgattgtagaaccctagggctatgagcaaagataagcaatagccaggcagtggttaccacaggtgttgggtgagacccaatgctgtgctgacttcaggtctgacctagcacagtcccaagggcaatggccacaagggtgcttgtgtgatcccacccacagttctaggcagctcagcacagagagagagagagagagatgccatttgtttgggagaaagtaagggaagagaacaagagcctatgtctggaaatccaaagaattcttccagatcttatccaagaccaccaagtacctctaagagaccgcaagagtcacagtgttactagactcgaggtgccccctaatgcagttatggctacagtgaccaaaaacttagatcacaacactcaagtccctttgaatacctggaaggcccttcccaagaagaatgggtacaaacgagcccagacttagaagactacaataaatatctagctcttcaatgcccagatactgacaaacatccataagcatcaagaccatccaggaaaaataatcttaccaaacaaactaaataaatcaccagggaccaatcccagagagacagagatatgtaacctttcagacagagaattcaaaataactgttttgaggaaatgcaatgaaattcaagataacatagagaaggaattcagaattctatcagatacatttaacaaagagattggaataattaaaaagaatcaagcagaaattctggagttgaaaaatgcaattaacatactgaagaatgcatcagagtctcttagcagaattgatcaagtagaagaaagaattagtgagcttgatgacaggctatttgaaaatacacagtcggaggagacaaaagaaaaaaagaatgaataagaatgaaggatgcctccaagatgtggaaaatatcctcaaaagggcaagtgtaagtgttattggccctaaagaggaagtacaaagagaaataggtgcaggaagtttattcaaaaagataataacagagaacttaacaaacctagagaaaggtgtaaatattcaagtgtaaaaacaccaagcagatttaacccaaataagactacctcaagacgtttaataatcaaactcccaaagatcaaggataaagaaaggttcggaagaaataatataaatagagttccaatatgcctggtagcagacttttcagcggaaaccttacaggccaggagaaactggcatgacatatttaatgtgctgaaggaaaaaaaccttttatcttagaatagtatatccaacaaaaatatcctttaaatatgaaggagaaataataactttcctggacaaacaaaggttgagggatttcatcaacaccagacctgtcctacaaaaaaatgctaaagggagttttcaatctgaaagaaaaggacattaatgagaaataagaaaacatctgaaggtgcaaaaaactcacaggtaatagcacagagaaaatcacagaatattataacactgtaattgtagggtataaactattcatatctcaagtagaaagactaaaagatcaaccaatcaaaaataataactacagccacttctcaagaaatagacagtacaataagatagaaatagaaacaacaaaaagttaaaaagtatgcagtgggggggaatgaagttaaagtgtacagtttttattagttttctctttgcttgtttgttagtctatgcaatcagtattaagttgtcatccatttaaaataatgggttataagatagtattttcaaacctcatggtaacttcaaatcaaaaatcatacaacagagaaaaaatatgcaaaaaataaaaagcaagacattaaaacataccaccagagaaaatcacctttactaaaaggaagaaagaaagaaaagaaagaaggaaggaaggaagagaagaccgcaaaacaaccaggaaacaaatatcaaaatggcaggagtaagtccttacttatcagtaataacattgaatgtaaatgaactaaactctccaatcaaaagacagagagtggctgaatggataaaaaaaaaaaacaagattcaacaatctgttgcctacaagaaacccgcttcacctataaagacacacatagactgaaaataaagggatggaaaaaatatactatgcaaatgtaaactgaaaaagagcaagaatagctatacatatatcagacaaaatagatttcaagacaaaaactataagaagagacaaagaaggtccatatatgatgataaaggggttacttcagcaagaggatataacaattatatatatatataatatataatatatattttcacccagtgctagagcactcaggtatataaagcaaaaattactagagctaaagagaaagatagacctgaatacaataatagctggagacttcaacagtttcagcattgaacaaatgatccagacagaaaatcaacaaagaaatatcagatgtaatctgcaatacagaccaaatgcccttaatagatatttacagaacatttcatccaacagcctcagagtacgcattcttctcggcacatggattattctcaaggatagactgtatgttaggccacaaaacaagtctaaaaaattcaacaaaattgaaattatatcagtatcttctctgaccacaatggaataaaactataataaatcagtatcaagaggaattttggaaaatataaaaacacacggaaattaaatagtatgctcctgaatgaccagtgggtcaatgaagagattaaaaaggaaataaaaaaatttcttgaagcaggtaataatggaaacacaacataccaaaacctacgggatacagcgaagccagtactaaagagaagtttatagctataagtgcctacatcaaaatagaagaaaaatttcaaataaacaatgtaacaatgcatcttaaagaactagagaagcaagagcaaaccaaacccaaaattagtggaagaaaataaataaagatcagagaagaaataaataaaattaaaatggagaaaacaatatgaaagatcaatgaaacaaaaagttgggtttttctttttctttttttcctttctttttttttttctgagacagagtttggctctgtcacccaggctggagtgcagtggcatgatctcagctcactacaacctgaacctcctgggttcaagcaattctcatgtctcagcctcctgggtaactgggattacaggtgtgccaacatgcctggctaatttttgtattttttgtagagatggggtttcaccatgtaggctaggctggtcccaaactcctggtctcaagtgagccacctgctatggcctcccaaagtgctgggattacagggatgagctactgtgcccggccaaaaaaatgattttcttaaaaagataaacaaaatttttgtcagttgacaagacttaaatctaagacttcaagctatgaaactattaaaagcaaacattgggaaaactctccaggcaagtgatttcttgagtaataccttacaagcacaggcaaccaaagcaaaaatggacagatgggatcacatcaagttaaaaagcttctgcatagtaaaagaaacaatcaataaagtgaagagacagcccatttaatgggagaaaatatttgccaacgatccacctgacaaaggattaataaccagaacgtataaggaacccaagaaactctataggaaaaaaatctaggccaggcgtggtggctcatgcctgtaatcctagcactttgggaggccgaagcaggtgaatcacctgaggtcaggagatggagaccagcctgaccaacatggagaaaccctgtctctactaaaaatacaaaattagctgggtatggtggcccatgcctgtaatccagatcttcgggaggctgaggcaagagaattgcttgaacctgggaggtggaggttgcggtgagtcgagatcgtgccattgcactccagcctgggcaacaaaagcaaaactccgcctcaaaaaaaaaaatctaataatcccattaaaaactgggtgaaatgtctgaatagacatttctcaaaagacatacaaatgaccaacaggcatatgaaaaggtgctcaacatcactgatcatcagagaaatgcaaatcaaaactgcaatgagatatcatttcatcccagttaaaaaggcttttattcaaaagacaggcaataacaaatgctggtgaggatgtggagaaaagggaactctcgtacactgttggtgggaatgtaagttggtacaaccactatggagaacagtttggaggttccttaaaaaattaaaatggaactatcatgtaatccagtaatcccactgctaggtatatacccaaaagaaaggaaatcagtatattgaagatatgtcttatctctgtactcccatatttgttgcagcactattcacaatggccaagatttggaagcaacccaaatgttcatcaacagatgaatggataaagaaaatatggtacatatatgcaatggagtgctatccagccataaaaaggaattagctcttgtcattgtcaacaacgtggatggaacacgaggtcattatgttaagtgaaataaaccaggcacaaaaagacaaacttcacatgtcctcacttatttgtgaaagctaaaaattaaaacaattgaacacatgaagatagagagtagaatgatggttaccagaggttgggaagggtattgagggtgcggggaagggacggtgagacagtggggatggtaaatacgtataaaaatatagttagatatttagaattaataagatctagtatttgatagcacaacaggttaactatagtcaacaataatttattgtacatttaaaaataatcatttgtaacacaaagaaaggataaatacttgaggtgatgcatacccatttgcccatgcaataatgcctgtatcatgcctgtatcaaaacatctcatgtaccccataaatatatacacctactacatacctacaaaaataaaaaaaaaacccctggactctggagtcagattcattcaattcaaataatatttattgagagccaaatagcagacattgttccaggtgctaggaacagaatcgtgatcctggcttcatggacttccattctcatgattgcctaggttcaaatcctaactctacctcataacctcaggaaatatgttttactgtctgaacttatctcttaatttgtaccagattcatgtttgttgcaagaatttacagaggcaatgtatataaagcatccaatatcatgcctagctcattgcaagtgtcacttatttttatttttgggtgaaagtctgatgcaagccatatttatgccataaatttaattggatgtgaatatgatctactagttgaaatgactctgatttctatgctttttaatctagtctgagcagcatttatgatacagtaatggccaaaagacaatgaaaacactattatttatcttaataagacaatcctaagccaaaagaacaaagctggaggcatcacgctacctgacttctaactatactacaaggctacagtaaccaaaacagcatggtgctggtaccaaaacagagatagagaccaatggaacagaacagagccctcagaaataataccacatatctacaaccatctgatctttgacaaacctgacaaaaacaagaaatggggaaaggattccttatttaataaatggtgctgggaaaactggctagccatatgtagaaagctgaaactggatcccttccttacacctcatacgaaaattaattcaagatggattaaagacttaaatgttagacctaataccataaaaaccctagaagaaaacctaggcaatactattcaggacacaggcatgggcaaggacttcatgtctaaaacaccaaaagcaatggcaacaaaagccaaaattgacaaataggatctaattagactaaagagcttctgcatggcaaaagaaactaccatcagagtgaacaggcaacctacagaatgggagaaaatttttgcaatctactcatctgacaaagggctaatatccagaatctacaaagaactcaaacaaacttacaagaaaaaaacaaacaaccccatcaaaaagtgggcaaaggatctgaacagacaatcctcaaaagaagacatttatgcagcccacagacacatgaaaaaatgctcatcatcactggccatcagagaaatgcaaatcaaaaccataatgagataccatctcacaccagttagaatggcaatcattaaaaaatcaggaaacaacaggtgccggagaggctgtggagaaataggaacacttttacactgttggtgggactgtaaactagttcaaccattgtggaagacagtgtggcgattcctcaaggatctagaactagaaataccatttgacccagccatcacattactgggtatatacccaaaggattataaatcatgctgctataaagacacatgcacacatatgtgtattgtggcactattcacaatagcaaagacttggaaccaaccaaaatgtccaacaatgatagattggattaagaaaatgtggcacttatacaccatggaatactatgcagccatgagttcatgtcctttgtagggacatagatgaagctggaaaccatcattctcagcaaactatcgcaaggataaaaaaccaaacaccgcatgttctcactcacaggtgggaattgaacaatgaaaacacttggacacaggaaggggaacatcacacaccggggcctgtcgtggggtggggggaggggggagggataacagtaggagatatacctaatgtaaatgacgagtaaatgggtgtagcacaccaacatggcacatgtatacatatgtaacaaacctgcacgttgtgcacatgtaccctagaacttaaagtataagaataaaaaaaaatgtagtcaattgtggtgagtcataggagggatgccaagtgtggaatcaccacagatgccagtcaaggctcaacgtgaccagctgttcagggtgctttgacaatcccaagccttgaaactacctaaaggctccttctgagtcaaatatcaaaaaaatggatcccaaatgactcctaatatgatttctcccagatgctctttctgataactttgtttccgacgttgatatctgatgctctcctaattactttggaccactttcttcctggaagactctatatggctcttatcattgagcagctctttgcaatgaagatgggaaaagacctccactatcttctgttatgatctaaggccctcgatgaggtacccattgcctccatgtatcttcctgggaaggcctttctgaggctttggctggtatcttaatttcttgtggaatatacatactggtgttctggtgctgtgatgtctggatatgttgaggtattgaccataccctggccagtggttttccttttgtttatatggagagagtccctgctctggcaagggaagagatgaagggaagagagggtagaagaggggaggggagggaagaggaggggagaggaggggaggggaggggagggaacaatttactgtgcctttttaaaaagagatcagccaataaaaaggtagattttggagacagacaaatctaaaaaaaaaaaaaaaaaaaagaaatgaaggttccaaattgatcacctaaatcatacagtcctttatcaaaatgcctggaagcctgtctaggctggaggttggctaacagcatacactcagctgacccggggagtactgatttattttcctatgttagaagttaggcctcatctgaaaggcagagagaagggcatcatcacactctatgccctatggactgggattggggtgggcactggagactattcaagagggcatttttgggaaaataggaagagagctcatggtggaagacagggaaagtaccagtagaagccgcattctgacaacattccacaaggagagaagctaattaaaaatgggaacctgacataggccaactaaatgagtatctctggggctgggatctggcagtgatctttcataagaaaaactcccctagataattctaacatagccagaggtaaaaacaacaacaaaaaaccccactactgctccagactagtagttctcaaagtgtaattcgcagaccagcacacgtgggtatttgtagaagtgcaaattaacaggaccccccaccaccccagatctactgaaacagaaactctgagggtgggactcaggaatctgtgtcttaacaagctctccagtgattctgatgcttgctcaagttggagaactactgctctagataagtcataccagaccaaaaaaacaaacaaacaaaaaaattaggaaggtcaggaaggcaggcagggtaaaatggatcagggtggaagtccactgtggtttccttttgtactttagagaagaatgaaaaacgcacattgctcacttccatacaactttggagaggggaaggtatctaacccttcacctttctctctcctaaagctccttcctaggagccattaaatgacagaggcctcttggttccaagtgggttttaggatttttaaataaaatgcagagactaataatgaaatttgttggaccatcagaaaggacagcagatggcccttgtgcctaggagggagggagggagggtaaccgctttccagaccaggaaaaaataaactaagaataaaaagaaaaccaaatgattaaaactgaactttgctttacttttcccttttatttcatgaaagcagtgtttgggcacagtagagatatgttaataaaattgaataatgtctcttgcactaagttttcagtacaagatgaaaactgcataagaacatgttctaatgatgcgttggttttctcacagtaacatccagcccccagaacattctctggcagcacccacactctcctgtcctagtgaataaacctggaacaaagctgaaaatctgaggagctgccgcctggatggggaaggatatgcttgtgaaatgtagcttggctctgttgctgacttagatgggagtacaggaaagtcattagtttctctggccctcaattttctcaagtaggaaatgacagaaaccacccaaatgaactgaaatgtcaaagtgatctccacaggcccaggaagagggccaggtgccatagccaaacaggatagcagaaaatcgcacaggctcatggtgtcacattctggtaaatgggcatgatgaaatttaactaagctgaaaaactgagaagtttagtgatcaaatgtgggccaaacattctatgggcatttttgttgttgcttattttaatggtcttttcctcctcatactcacatgctgtgcaaaaattatataattatataaaaaatatgaattatataagtaaagaaccccaaccaaatctcaactgattttgtgaaaaagaaatatcttttttttgcttactcttaagttctttttatcagaaaacaaataccacatgggattattattttaaacacaagctgcatttaagagaaagtgtctagtaaaccttctggggctgtaaattagctgctaattttgtttgactaaaggctgtaaaatgcatttctgggaattattgtgcacagagaacatcctcctaatacttcagtgggcttgaacagagaaatggaatcctattcagtatacctgttactaaactgaggctactccacgacccaggctcattctatctaactacatagccagcttttctggatttgtgaaagatgagattttgggaaagaacatgagaaacaatgagtcattcacagacacataagtagagatttgaaattggtgttcagaccatctaatcttcacatttcctcctttgttcaatctcattccagtctctgaaattttccaagggcctgtttattactctgttctattcacctactgctatgttcagttactgccccctgtttctctaatggagttttgctttcaagactgggcacaactcttctcaatatgtatttacatttttcatttccttatacaagttccatcattttttctttatgatagttttctttaacctgtttattcatttgtttcatttgttatattttcatgttttttatcctggtccttattttcctccatgacacctcttcttatacttgatgttgttctctagaatgctgttaaatttgctacctgtctctttcaaaatttacctgggcaatggtagcacacaaagggccatgcagacttgccaatattaggctggtttggcctagcatagtacctggcacacagcaggcattcaatcaatatctgttcagtgactgcctgaatgaaaatagaaatgatatcagtagttttttgcaataatcttaagcaaaattataaactaataacttccactcctttaaatgtgtgtcaacttttctgtactaattggaaaaacatctagttcatgtggatcaaaattgagtctatatgctacgtagggcaaaggcatgcctggattttaacatctcatcctcagtgactctaatggtgcctggcacagaggagatgcccaataagtttatatgaaatggcttagaatggactaccttctccatgcgactaatgatctgttactacttcctgaaaggttagccattattgatataccacttctagatgctgtgacaaatggcacagctcagcagcaaaagtactttttaaagtctatgggcctccacaggttgagtttgaaaaggatctgttaatcctctgaaattacatgtgatttatggggagaaagtttacaaaattattaatactcttgaaggggaatatgacctccccccaccccaaatttcagaaccacagtggataatgaaagtttctatgctgtaagagcaattaggaagtcctgaaaaacagggaatttagtcaggagacttgagttgaaatcctaactctgccccttgctggctgggtgaccttggccaagttttaaactctttcttatcttcagtttccttattatgacatggtgatgttaatgacaagtctctagacatagtggttaaacttcaacttgaacccaaatttttctggctctaaagcccaggctcttaacatctatcatcctacattaattaaatgagataactgatgtgaaaatgcctgatgtaaatatttgttaaagcaacaacaaaaaatgtcatttgtcaaagtaacaaagtattttttaaagtaacaacaaaagagacagataaccacaaagaaaaggccactttagaaattcctctttgacctattaaagaatgttcaagttcaaaatatgtttgtcattatgattaaaaatccaaccccaaaacttgggtgaagacggcataatctgttagtttggatatatacagactaaggggattctttggaataccctttgtctagagtgatcttatgacatggtacggataactagactcacctaacattcaaatgaagggctgtgtgtcttctatactttgtagacagaggtggcagatcatctgcttttaaatatagagggctcccattctgctaggatccagagggaatgagggtcctatgttacagatgtccctctgcctgcacaaaaggctgaagaacaagccatcatggagtgtgggagatccagctgttgtccatttccagaagaggagtgaatagtggcttaacagagaggacccttgcctggttctctttggaaatttcacagtagtgaggccaggtgcggtggctcatacctgtaattctggcactctgggaggctgaggcaggtggatcacttgaggtcaggagttcaagactagcctggccaacatggtcaaaccccgtctctactaaaaatacaaaaattagccgggcgtggtggcgtgcacttgtaagcccagctactagggaggctgaggcaagagaattgcttgaacccaggaggcagaggttgcagtgagccaagattgtgccactgcactccagcctgggcaacacagcgagactctgtctcaaactaacaaacaaaaaatttcacagtcgttatgaacagataatatgctcaggtattagccatttcattgcattgttttgacaagtgacaggaattaggtttgctaatgttggaagaaaaatctcacttgttgcttttaacttaaaccttttatggttttgagataggtttattcactgggctggagaatgaaggatttatctgtattagtcggatttgatcagttttcaagtagctactcagtgtcaggcctatacattatctcgtttaactctcttaacaccatggtaaggttgactgtatcataatctccatttatcagataaggaaacaaagattcagagaagtcaccaagttgagatcattgcccagctgcacacagctagtgagtggtgaagctgagacacaaatcagggcttccgacgccactttctattacactttactatgctgtgcattcgtgtaaaagcatgatatttttaaagtggcattccagctgccagaaggatatcaaatcaagtactaaagacaatattattagaaatggaaatctggactcaccaagaaatgtcttcagttctatataataggaagactggtattttgcttgatatgggtgtttcaatatcatctgctcctaaaatgcagtctagacacctcttgtgacctgctcaggtgatactaatgaagtttgggtcatttttagcatctacagagaacagagtaagagtgctgtgtgttcaatactattgcagacttatgggataaactggattttcttgctttactttataaagctaatgcctgattacaaatataagtttaaaacaaacctcaaaatttcttggcacccactctttgtggttggtaacatggacatctgtataaaatacccaagaccttcatagagcaaaagtgagtgggaaattaatttttattgggtatataatcatcactagccatgttcaaatactttttctctaaatcctttacaaagatcttgtaagttgggtattattacattcagtttagactaaacgaaatgcaaaaaaaaaaaataataaagaaaatagactcacaaggtaaagttgcatacttgagacataacaaaattaaatttcattctatgatgctgccacatagcagatgatacaagcagtatagaatacccataaacattatgttttaaggtatttccacctgtatctttcttggggcaggtaaatgaaactcactataaaccagttacaggtcctcctttatctgaggttttgctttctgaagtttcagttacctgcagtcaaccatggtctaaaaatattaaatgaaaaattccagaaataaacagtttattacgttttaaaatggatgtccttctgagttgtgtgatgaaatctcatgccatcctgctccatccctccagggatgtgagtcatccctttgtctagtgtatccatgctgtctgcccttagtcagccttcttggttgtcagattgattggtacaatggacacaaggtattaccgtgcttgtgtctaagtaacctgtgttttactattattacagtctattgttatagtttctattttaatataagttattgttggtaatctcttactgtgcttagctgataaattaaactttattatagatatctatctatatctatcacagatatatctatagatacgtacctgcgatatgtatctatatgcgatatgtatagatacatatcacaggtatgtatctatagatacatcggtatatatatgaaaaaacagtacatatagggtttggtactaaccacagtttcaggcatccactgggtggggatgcgggtcttaaaacacaacccttgtggataagagaggactactatatggaaagtcagagttagagagcttttgtaggttatgtagttcaatcttttgttttgctggtaaggagaagaatacaccttaattttgacttcttaactcgaaaagttaagaaacttgtctaaggtcacagagctagtggcagagcaagccaagcatcagtgtctccaaaatccagctcagtgttgtttgtgttatatcagaatgagtaagagttaagataagaacatgagtcttacagctccactatccatgttcaaattcttgctgaatgattggggaaacttacccaacctctctggacctcaggttattcacaagtaatacgaatataacagtatttgatagagccaattaaatgagttaatatttgcaaaatgctgaaatcagtgcttgccccataatgaatactcaataggtatttagatatttttattcttatctttcctcccaagcccaacctagtgtagaaacttctggaatggttgaattgaaggagaaatagtataaacagtataaaaaggtaaactttttaaaaagagaatcatgaagtagtgcttctacagagattgggggatggcaaacaacccatggagtaaattcacaagacttgacacttaagaatccaagagggctgcatgagatgagtccaggtaggcctcgtagacaaatcttagatggagttaactcaggaagccaaggagtatgagccagtagtcatcctgagcaaggataataatttttctttctgcctgccttcttgccttcttgtctccttgcctaccttccttcctttcttccagctttccctccctcttttccttccttccctatctccatccctcccttcctttcctacctccctcccttctttcttcttccctttcctccttctttccttccttcatttcttccttctttcctttcttcctccctctctcctacccttcttccttgcttccttcctccctccctcccctcccttccttccttttccttccttcctttccttccctccttcttcctccctctctccctccttccctacttccctccctcctactttcttctgtttcctctttccttcctctcttcttctttcctccctctcttccttccctccctcccaccttcctccctttcctcttccttcctctttcttccttctttccttcctccctcccatctccttccttccttccttctttctttccttcattcctccctccctcccttccttttttctctacctccctccctccttccttcttccttttcctccttctttcctttcctttctccttccttccctccctcccttcctgccttccacccttcctaccttcctgccttcctgcctgacttcctttcttccctcccccttccttctttcttgccttcctgccttgcagtcaccgaatgttttttgagtgactatgatgtgccaagacccggtataagggtgcacgaaataaagtctctaccctcaggagcttacttcctagtgggggagacagattataaacaaagacacaaataggtaatatactattatgtggtgaaaaatgctacgaagggaaagtcacagggagcatttttgtttggtttttttttgttgttttatatagaatggtcacaggtgcctctctgaggagcccttggagcagacacctgaatgaagtgaagccacatgcctggagaacaaatattcagactgagataagagtgaacacacacctgcagtgagagagagagagagttgggtgtgatttgcagacctgtaggaaggccagtgtggttgggcagagggagcagggaatgtaggcaggggccagatcacccagtatttgtaaactgaggcatggactgaatgatagggcggcttcattcatccaccaaaccacgtgctgagtaatctaccccaattccaaagcatgaacttgacaactgcttcttcatagtaatagatgaaggataaaaaaatttaaaaagcatatagatgagccaacttttatgtgcttaaagtgaaaacaatcatgtctataagacaaaagaaggaaagacatttgacatgctccatgtacctgagattcatctcgtgttaataaaatgttgaacatattacactattggccggtgtttagtttcagctgaggaactaattcctaaagctgcagcctgggggatggggagatagggtggacactgagacagggcatggaggaattcagatggtatttaccccagaaatatttactgaaattgggaatgctgagtcaagcctagccatgctagagggccttgggaaggcagttactagaatctccttgatttttttccaatttcagaagaagcaacaagaagaaagtgtcttgactaatccttctagtgaaagatattcacttttataataaggtgcttgtctacacagaggtttctgagtcaaaggaggagaacgtacaaaatagaccgaaagaagagcctgcctagctgctctttttcttttgtaattaccaagatcccgacggtttatacccactcaactgcaggtgctgggagaggagaggctactgtgacaaaaattatataaagaagagcccagcagatgcatttccagataaacaatgtaaaacatagtctatgtaagtgccataaaatttcactaataaaaaacacacatggctcagggaaacatttattatcaaaatggaagcaggaaagggcatatgctaagtcttattcatttcaataaatagcagaacgtgaattgataaaagttcttaattgaaaaacagttgctcatttgtagtttgatatttaaaagctttctaaacatgtatttattttgttttgccttgaagtaattagctattagactaactattttcttttcatgtcaggtacacagtggctccaaagtcaaaacaaggttagattggaaggaagcaaacaatgaaattgaagggaaatatcgacacttctcaatcaatgaaaatgcatcagcatgtatgagcatctttagctggcaataatacatcagaaataaataatgttagcaaaagagacagcatcattggctattcatagtatgtattcacggttgtacaataaaattctaaaggctgaggttgaaagtgaataaaaattattagttctaaacacttgaaaattccagcagcttagacatatttttgtatgctttcagtgccccaaatgtaaaacttaaatcattttatgaaaaaaccttgttcaatcttttaagaaatttgcatttcattgcaaagatggaacatagcatccttggctgagttattttctatagaagtcagtgccattttgtggtatatgattagcacattctaaaggcaaagattccagaacgtttaaatttagttgtgaaaaactgaaggcatttatccattcatatataagcatgaaaatgcaagcttcactttctcagtatgtttaaatgccacatattataatgggaattctagaagatgtgatcatcaaactctgatttcacgcttagaaatcaaataaaaaagagactggcctataattagaaaattagtcaagtcagatctaatatcaacacatggttgtcacagaacaaaaaatttttgctttgagaaaaatgagatatcattctggatgaatattctgggtcagtagaaaatagggaatcaaagtatagaaataaagtgtttatgtcactgtaaaacttctagttttctaaaataaaatttaaatatctgaaatagcagtttatacttcatactcatacagtcaatagacattggtagcttaagaaagaacttggtaagtgatgatttaaagagtgatatagattcagtagtattcaatatacagttgtaattgatgagctcatcaaactatggaatttgggatatttacataatatttacattatataatatgggagagatagcaagtatctataaagagtttaaattcccatactaggaaatgtatagtttgttttaatctatgtctacatttaaagtagatttttttttcagagacagcatatagttgggtattgctttttaaatttttaaatctaatctttgtcttttaaattatatttaacgtagttgttgatatggttgaatttatgtctattaccttgctacttgttttctatttatcccatttattcttgtttttttccctcaatgtctgccttcttttggattatttgttttagtattccattttatttccattagtggtttattagttatacctccttttaaatttatttacctaattttagttggtgccacaaggcttaaagtataaatctgtagtttatttttggaggatctttgccccacagattccagtcttaccatgctatttattttttagcgatttgattacgctctggtcaatatgtgattatgtgcaaactgtgtgtgtgtgcgtgtgtgtgtttatcttgcttgaggtttgttgaatttcttggatctgtgggcttagagtactcacataaaacttaaaataaatttctatattcttttttctggtatactgtctatgcactcttaattcatatagtcatgtttttatgtcagatattccattttttgtctttaaataatataccaattaatgtataacgtgatccttacaatagttatacttctatttccccatttttcctgctattgtgataatacattttacttctatatatgacaaaaaaccccatgatatacataacagtgtatataataataacatatttttgctttaaatagctaagtcttttaaataaatttttaaaacgagggccgggcgcggtggctcacacctgtaatcccagcattttgggaggccgagacaggcagatcatgaggtcaggagattgagaacatcctggctaacacggtgaaacccatctctactaaaaatgcaaaaaattagccaggcgtggtggcgggcgcctgtagtcccagctactcgggaggctgaggcaggagaatggcgtgaacccgggaggcggagcttgcagtgagctgagattgcgccactgcactctagcctgggcaacagagcgagactctgtctcaaaaaaaagaaatttttttttaaatgagaaaaagtattttatatttatccataaatttaccacttacatcacttcatttctttgtgtagacctgagtttttatgtggtatcattttctattttttaattaattaatttttttttgagatggagtctcgctctgtcgcccaggctggagtgcagtggcgcaatcttggctcactgcaacccccgcctcccgggttcaagcaattctcctgcctcagcctcccaagaagctgggactacaggtgcatgccaccatgcccagctaattttttttttgtatttttagtagagacggggtttcaccatgttagccaggatggtctcgatctcctgaactcgtgatccacccgcctcggcctcccaaagtgctgggattacaggcgtgagccactgcgcccagctatctttctctggttttcatagtttatggcaagaaacctgcagaatttcttacctttgttactttgtgaagtgtcttttttctctggatgcttttagattttttttttttagcaatttaattatgctgtggttaatatgtgtaattatgtgtaagctgcatatgtgtgtatgtgtgtgcgtgcgcttatcttgcttgaggtttgttgaatttcttggatctgtgggtttgtagtcacaccaaatttacataatttggtagccattatttcttgagatattatcccccatccattttttaatgtgtccttttttcccccaaatatacatgttagactgcttgatattattccacaggtcacttaggctctgctaattttttcactactctttttttctacatacttcattttggatgattctcttactatgtcttcaagttcatgggctttttcttttaatccaaatggtcacattttcatgtcagatattcttaatccaaatagtcacgttttcatgtcagatattctgttttatttttgtctgtagaaatcacatttgggctttaaaaaatatcctcaatttctctcctcatttcatgttttcctttaaatacttgcaaataggtttttttgtttgtttgtttgttttgagacggagtctcgctctgtcccccaggctggagtgcagtggcgcaatctcggctcactgcaagctccgcctcccaggtacccgccattctcctacctcagcctcccgagtagctgggactacaggcacccgccaccacgcccagctaatttttcattttcgtatttttagtagagacggggtttcaccgtgttagccaggatggtctagatctcctgacctcgtgatctgcccgcctcggcctcccgaagtgctgggattacaggtgtgagccaccgcgcccggccgcacataggtattttaacattcttgtatgctagttccattatctctgtcatttctgaatctatttctatttaatgcttttttcctcctcataatatgtcacattttcttgtatcttgtctagtaatttttgatagaatgctgaagattataaatgccaggtcatctggattttgacttccttaaaaaatattaattttggttttggcaggaagccaaacaaaaatccagatctaaagtccaagtttctagatatttgcccctcagcttctagcctgagcctctccaaactccagtctctgtcttctgagtcagccaggaagtaaatccaagctgttttgggttacccttccctctgcttatggaccataaattgcctcctggaagaaacctggggcaattgtagaaatcactttttttgtcttcttcctctcagagatcacagccctaagctgcctacaatctgatgtttgaaaacagctgcaccatatattttgttcagttaaattttttttttttaggccaggcatggtggctcatatctgtaatcccagcactttgggaggctgaggagggaggactgcttgagctcaggagtttgagaccagcctaggcaacatagtgagactctgtctctactaaaaataaaaaaaattagctgggcatggtggcacatgcctgtggtcccagctactcaggagccatctcaccgcagcctcgaattcctggcctcaagcgatcctcccacctcagcctcctaaagtgctgggattacaggcaaacaccactatgcccggctattgttcagtttttttttcttttgttttttgttgtttgcttttgcttttttgaggcagagtctcactctgtcgcccaggctggagtgcaatggcacgatgtcagctcactgcaacatccgcctcctgggttcaagggattctgctgcctcagcctcccgagtagctgcaactacaggcgcataccaccacgcctggctcatttttgtatttttagtggagacggggtttcaccatgttggccaggctggtctcaaactcctgacctcaggtgacccacccgccttggcctcccaaagtgctgggattacaggcgtgagccactgtgcccagcatattgttcagtttttaatgggaggttagggacaaattttgatactccattaacagcccaaagcctatttcccaaatctgttttagatacccttagatgaaataattcttacagaaaccatgagaccttaaatgattaatcataattatcaaagaaaactcctgagcagttaatgtcaaatgtaatatgatgtaagtaagttgattgataatattcgtgtcttgttaaaagaggctactttagtctgctgagatactgaacggattttcctaagggaaggagtatctgatatgaaataccagttaatcatcagtcaccaaccattaattaaatggctactttataaaggacattaaactgagcgctagatggagtatgttgttgcagtcatttcatagaaaagtctacaggggtaattataagaaaaagaaattgggtatttcaaagatctagtcactgatataagtggaatgtgatatcaaatgtgaatcaatactttaaaataatttttattaaatgcttattagatacagaagaatgctataaaaatatatgtaaacttaaaagtagtgcttctgaaactttaatgtgcaaacaaatcacctgagatcttgttaagatgcagattctgattcaggagtctggggtggggcctacctctgtagttctaaaaaaaaaaaatccaggtgaggacaatgtttctgctctgcagactatctttggagtagcaagagtaagagaagtgaaactacaatgatcatctgtgtgcccaccactggtgtaagaaaaataactttatttttatctctaatgtcttctgggtaccccctcctgatcccttccctccctcttagaaatgactacttccctccctcttagaaatgactactctcttgaattttgtttttatcatccttttgcttttcttaaaagttttaacacatttgcttgtcacttcaatatatattgttagggtttgcatatttttgaatgcatgaacctaatataaatggaatcatttgcatatatccttcttcaatttttcataccacattatgttcctgaggttaattcatatcattgtaatcatagtttgtataaacttaatttattttcatcactgtatggaattctattgtatgaatatacataattcattttaccgttgttgaattttgaaatttaggttttatactgccatgaaaattcttgcataagttcctggtgcacacatgcaacacttagtcagattatatacataggtgatgaattgctggctcataaggtatacacattttaaactttagtagattatgccaaattgttttctagagtggttatattgacttgttctgccaccaactgtgtgtacaaatgttctggttgttcctcatctgtattagttttatattgctgcacagcaaattgtcacaaatttactggcttaaaacaatatccacatattagatcatagctctataggtcagaaatccaggtgggcctggatgggttctctacttggggtctcaccagtctaaaatcaaagtttcagctgggctgactcttatctagaggcgctgtggaaaaatctgcttccaggctttttcaggctgttggaaacattcagttattggcagttacagactgaagccccttttcctgctgtctgttagctgctaaggaccactctcagctcctggaggccactctcagatccttgtcccatagccccctccacttatcaatggagaccctcctttgcatcaaattcctctcatgcttaaaatctctctgagttggataaaagtcaatatataaagagctaatgtgattagattaagcatatccaggcaatctcccttttgtcatataatgcaccatagtcacaagaataattccagcgattaaagttatgagggtcatctatagaattctgcctactctagtttactgatagccagactggccccatgattcactactgtttcataggtaaaatatattcaccacttcccaaggttcctagtgctttgattccattacagcatcagttcaaagtctaaaatctcaataaatcatctgaataatctaaaccagatggaatataaaaaggagtcagcaatccaaagcagtgttgaaatccagtggagcaaaactggttgggaaaactccactgagtttcaaggcctgggaataattctctttagctctcagctcctccctctccacttttggtttcaccctctgagtcaactttcttttttcataaagagtagatgaatagttttatctccctgcttctcgcagtagaatttgagcagatgtaagagtctcttttcattttatactctctctgtcccttttggtccagctggtagtatttctgctgatacaattttctcaagaactttctggatctcctgtggatatcacagtgattcactgcatcatacagaacacatgctgacaagtcttttgagataatcccttctctatttttggcttctactgaaatggttgagggacagaacccttaagcccagaggtcctctggtttaactgagaagatctgtgagaaacacccttaatctcctggaagggtagtttgtgtggtaaaatactctggccttttgatatttctgagttttcaacaaagaactgtatagtatacactcagacttttctttatgccactgttttagcagccatttatgacttttagcatccttttgccatctggagaggctgtgaattttctaaattatctactctggtttctgtttaaaagttcttccctcaatttatctctctcctttcacaatttactataagcaacaaggagaaatcaggctgtagctttaacacctttcttggaaatctccttagctatatattaaagttcattgtttacaaattctgctttccacataactgcaagatgcaactttgctagctatttggccactacataacaagactctcccttcctgcatttctaataatatgtttctcacttctttcttagtccgcactgacagcattctcaaagcccagatttttttaacctatttccttatattttaatgggttttctgtggctcatggtggctcatgcctgtaataccagcactttaggaggctgagtcaggaggactgcttgaacccaggagtttaagaccagcctgggcaacatagtgagaccccaacactgcaaaaaattaaaaaaattagctgggcatggtggtgtgtgcctatagtctcagctacctgggaggctgaggtagaaggattgcttgagcttgggaggtcaaggctgcagtgaactatgattgtgccactgtacttcaacctgggtgacaaagtgagactgtctcaatcaatcaatgaatagataaacaaaaaatgaatggaagttcttgtagacaaatatatgtggtttggcttttatttatccaatatgacaagccctaaattttattttatttattattttattttgagacagtctcactctgttgcccaggttggaatgcagtggtgacatcgtggctcactgcagcctcaacctcttgggctcaagtggtcttcccacctcagcttcctaaatagctggaactacagttatgtaccactgctcctggctaattaaaaaatttttttttgcagagaagagatcttgctatattgaccatactgaagccttgctttttaagatgatatttagatcatttacatttaatgtaattatcaatatttttagtttagtttcccaactttctatgtctttttatccaatttattttctcttcttttccttattcctgcgttttttgataagtatttttatgattacattttatttttcaggattggattattagttacacatttttgttttattatttttagtggttgctctagggtttacattattcatcttaacaaataacaccctacttcaaataatataataatatatattatttcacatatagtataaaactcataacttccattttcctcttttatcctttgaatgatactattgtctttcattttacttctaagatgttgtaaacctctcaacaaattgtttacatattttctttagacattcaattatcttttaaaatctttaaaaataagtaagaaaacatgtctcatatttatctacacttttaacatttccagtgctcctcatttctttgtgtaaatcccaatttctatgtagtgtcatttgtactgcctgaagaattccctctaatgtttcatttagcacagatctgccatcaattcatgttctctgcttttgtttgtctgaaaaagccttttttccttcagctctgagatattttttgctggttatagaattcagagttgacagttcttttttcttttagcactttaaaatgctattccattgttttttggcttacttatttttaacaagaagtttgtaataattcttttgttgttctgtgtataatatttctatttttttggctgtatgaaagattttctctttatctttggttttaagcaatttgtctatgatatgtcaaacagtgtttttaaaatattaattctgcttggtgttctctgtggtctgttatctttattaattttagaaattctcagtcattacctgttcaggcatttcttctgtgcatttctctctctttcctttttctacatgttaaaccaggtgatattttaccacagcttgtggatgctctgctcttgtttttctcattttttgtctctttgtattttagtttagataatttttattgtcttatcttcaagtcctctgacatattcttcttctgtgttcaagctgataatgagcccatcaaaggaattcttcatctctgatatattcttccttcatagcattcccattggacttttaatgactttctctctactgaaatttcccaacttttaatgtttgttgtgtatctcttctactggatcttttgttttgttttgtttttggagacagggtcttgctctgtcacccagcctggagtgcagtgatataatcatgggtcactgcagccttgacctaccaggctcaagctatccttccacttcagcctcttgaatagctgggactacaggtgtgtatcaccacacctggatttttattttattttatttttgtagagacagggccttgttatgttgcacagactgttcttgatctcctgggctcaagtgatcctcctgccttggcctccgaaagtgcttagattataggcatgagccaccatggctggctgaccttttaagactagagtcatagttattttgaagcccatgtctaatatttttacctgggccattcttaagtataatttttttgatgtttttatcctttgaaatgagtaattttgttcttgctttttgggctgtatcatattttttattgaattccagaattggtataaaagtatagtagaatgcgatttaaatagtattttcattaaaaatggatacacatgtttttgtgtcaagtaaacattcagaatcttaaagaaaaattgattaatttattctcagaaatgtgatatatagcatacaagataagaagtttgagcaataaataggtcaaaattgtgctgatgaacttcattaaaattttaacttcattaaaaattaaaattttaacttccttaaaaattaaaaataaaatatgtaattcaggaacatatatttctaaagtatcccattatactgaatattttagagtaacagttacaatggtatgtacatggcaagtaaaacagattttgaccttttcttgcaatagtagcaaaataataacaacaacaacataaaaaatcataatggtaaagtagcttatttacaaagtgaccaggagtaacattttatacccactctcacatgtaaagtgataagtggtacagaaaatgtattcagtgggaaatgtgggagagggtactccagagatagcagggagttataatggtctaggtctggacaatcacagcatcatatccctggattataatgattgatttgggaccggtcacagaactcaaacaaagactattagctctaacaagagctgttttgggaccctttgcagttagaactaaagttgtaaaaagataagactagattgacttggtgccattatgtcaccccaaagggtgagcctgaattaaaacagccaaaacacagaaaaatggagtgatggacagcaataagtttctgataatattatttaagtctttggattgagctatgcctaaagatctttttcagttataagaaccagcaaatgattttttcctatttttaaatgtaatttaattatttatctatgtttaaatcaacagataaaattgtatgtatttattgcatgcaacatgatgttttgaagcatgtatacattgtgaaatgactaagtataattaacatgtgcattatctcacagttatttttgtggtgagaacactttacttatactttcagcattttataagaatacaatatattaactatagtcaccacgttgtacaagggatctcttaaacttattcctcctatctaactgaaaatttgttatcttttgatcaacatctccccaattccctccttgcaatcaccttatcccctagtaatcaccattctactctctacttctatgagatcaacttttttagattccatatggtgagatcatgcagtatttatctttctgtgcctttcttaattcacttaacataatgtccttgaggtttatccatgctgttgcaaatgacaggatttcccttatttttttatggacaaatagtactccattgtgtatatgtaacatttttcttatccattcatccatgatgaacacttaggttgattccatatcttggtgattgtgaatactgctgcaatgaacaccaaagtgcagatatctgttttagatgctgattttatttcctttggatattatctcagtggtgggattattagatcacatggtacttatatttttaattttttgagaaacctccatactgttttccatggctgtattaatttacattctctccaacagtgtacagggttctcttttctccaaatcctcactaacacttgctatcttttgtctttttgataatagccattctaacaggtatgaagtgatatctccttatggttttgatttgaatttccctgatgattagtgatgttgagcaccttttcatatacttcttggccattttgtatatgttctttggagaaatgtcaattcagatcctttgcctatttttaaattggggctttgctgtgtttttgttttgctattgagttaactgaattccttatatgttttggaatattaactccttatcagatgtatagtttgcaaatattttctcacactctgtaggttgtcttttcactctgttgattttttcctttgatttgcagctgctttgtagtttgatataatcccagttatctatcttgcctttgttgcctgggcttttggttcatgttaaaaaaaataattgcctagaccaatgtcatggagctttctcctatgttttcttctagaagtttcatagttttgggtctaacatttatggctttcatccattttgagttgatttttatatatggtaggagataaggatccaatttcattcttctgcatttggatatccagttttcccaacaccatttattgaagagactgtcctttcctcagtgtgccttcttggtacctttgtgaaaaatcagctgactgtaaatgtgttaatttatttctgtgtactttattttgttccattggtttacgtgtctatttttatgccagtaccaggctgttttggttactgttattttgtagtatattttgaaatcaggtagtatgatggctccaaatttgtttgcttgtttgttttgctcatgattgctttgtctatttgggaccttttttgatttcatatcaattttaggattgttttttctgtttctgtgaagaatgagccaggcacggtggcttgctcctgtagtcccagcactttgggaggccaaggtgggaggatcatttgaacccaggattttgaaaaattagctgggtgcaatggcatgtagctgtcattcaggctgctcgggaggctgaggcaggaggatcctttgagcccaggagttcaagacagcagtgagctatgattgtgccactgcattgcagcctaggtgacaaaacaagaccccatctcttaagaaaggaagaaggaaagaaagaaagaaagagaaagaaagagaaagaaggaaaagaaggaaagaaaataaaaaaaagaaaggagggagggaggaaggagacagagaaaggaagaaagaaagaaagaaaaagaaagaaaaacagaaagaaaaagaaagaaagtcattggtattttggtagagattgcattgaatgtatagattgctttggataatgtggacattttaacaatattaattcttccaatccatgtgcatgagatctctttctatttgtgtcttcttcaatttctttcatcagtgttttatggtttttggtgcagagatcttttacctccttggttaaatttatttctaaatattttttgtagctattgtaattaggattattttcctaatttcctcttcagatagcttgctttttgggtacggaaacgctactgattttttttttcccaacaaatgatttttaacttagacaaatttacactgggttttatctcctttcaaaaaaatgaggctgatggaaaattcaagagtcaatgttttttttctaagagagaaacagaaaaataaataacctggcattagggtgtagtatggcctggagaaaagagatgctggagatcagcacagcagcaagagtcaggatgataaagagagagagagagagaaaaaaaaaaaaacactaagtaaccaaagataaagtactgagtgggaaaatattacttccaataagggaatctgatccagcacaaagtctgggctctggaggaaagaggcatgagaaagaaaaatataggatagctctttttaagtcaaagacatgaactgtttactccaaattagggcagtgaagacctgagttgcagactgtctggtgatatcttgcctttctgttaggtaagcactagggtggctgagctgagctgctgcaaatgtgacataaccggtttgggactatggtgtgcacctgcttgcgctatatgcatggcatgacccaattgagattatggtgtctttagttggcttgtcctagtggcagcaggtgaggtatccagatctgcacctgaaccgaggtatttgaataagtgatagaggagcaattcaaaaggcttttctgaaagtaagtcagtgagactggttgtgtgatggatgagggacctcaggaagagagaggagtaaatactgatgccaaggatgctagcttggactctggatgaacactgacatgtgtgactttgagtttaacaattgctaaactgtgatcaaaattatgggaggcattacactgaaaggcaaaactcaaagaaaactctaatatagtattagttgaaaagtaaatgggggtaccatgaagataactaaagccatatttggtatacatttaaaatgctagaatatgtcctttggatgtgctgtttgcatatagggtacacagaaggggacttttatcttgttaggttttatttcagatatataatggctctttttgttcccagtgaatttgggatgttctatgtgttgcttaatagtaaaatatttaaatgttaaattattagtatgcaatatgtgttagtataaatcaagtactttcattgaatctctgaagataaatacaaccatgtaatgtttaattttgactgtcttgcaaacgacctgaacatcaattaacaatctaataataatagtaactaacagtttttcatgctcaggcactattctaagtgctacacaatctggtaacctatttaatgttcacaactaccctacgaagcaggtacaattagttctcccatttactgatgaggaaaccaaatcactgggaagttaacttgctgaagtcgcatagctagtaaatagtagaaaccaatattagattctaggcagtctgattccagcgcttaaactcaaacactcatctttactggctacatgttgtatattcacatacacacacacaaaatttaacaaaacacttataaacaaagtactgtgagatctatagataagaacatccagtcttgctgttaggaaatgtggctgggaaaatagaatatttatatgaaaaagataataatagaagacagtgtgtaggaagtgacagatggatggcacagacaaatcactctgcagaggttgtagagaatggggcaggggtaggttacaggacagatggtcttaaactgatggataggacctacctgtaccatctggttcctgcccacctctctaaacttatcttcctgacattcaccaaattctagccacacggaccttctttgtgttcctcaaaatgccacactcttttctgtcccacggcttttacaattgttgtgtcttctgcctggaagactctttctttaaatcttggcaaggctgcctcctttattattcagaagtcagatcattgtgccctctgatatggtttggctctctgttcccatgcaaatctcatctcaaattttaatcccacatgtccagggagggacctgtaatccccatgtgtcaagggagggaggtgattggatcctgggggtgatttccctcatgctgttcttgtgatagtgagttctcctgagatctgatggttttataagtgtttggaagttctttcttcactcttctctgtgctgctgccttgtgaggaaggtgcctgcttccccttcgccttctgctatgattgtaagtttcctgaggtttccccagccatgcagaactgtgagtcaattaaacgtctttcctttataaattacccagtctcaggtagtatcttttagcagtgtgagaatggactactacaccctccttaatgagaacttccttggtgacccaaactgaaatactgcttcactcctaccccagtccactagcctgtttgatttcattcatgacactttccttacctgaaattatctacttgctaacctgcttatggtctgtttctcttcactagaatgaaagctccacgagcaaggatctatgatgcctgtcttgttctcatcttttttattttttccctcaagtagtttctgaagtttctacctcatctacacaatctttctgggctttaaaggctatgagggaatgtccctctttgacttgttttgaagccttgggcctacttatttgtatataagagaatatttttaaatggttctcttctttatatatttaaagcatgaaatgctctgaatatcaatgaacccaatcacatttgggtaatagaaaaggctgttttcttcatagttgattctttttttaaaaatttaatttcttatttatttattttgagagagagtctcattccattgcccaggctgaagtgcagtggcatgatctcagctcactgaaacctccacctcccaggttccagcgattcatacacctcagcctcctgagtagctggtattacagctgcacgccaccatgcctggctaattttttgtatttttagtagtgatggggtttcgctatgttggccaggctggtctccaattcctggcctcaagtgatccgcccgccttggcctcccaaagtgctgggattacaggcctgagccactgtgcccagcctgtagttggttcttttgaaatgttcctctcctttatgggccaagctgatagcatttgctttaccctctccatttcgtatatttatcagccatcaaaggcttttcttattgcttggaacttaattgaatgatgtttttgtttctttaccaacaaatgaacacaagcggctttcgaaaatactccaaaaaacagtgagctgtaggcaagattttattcttcatgtgtgatatattttggtaattaaggagtcaattctttggctaaatgctgaaagaaaaatgatgattattgtgtaggataaagctgtgaattatagaatactttcaactctgtttaaaatctaattaacattaattgttacattaattttccctgtgaaatttactaactgtatacaaaatgatatttaatcttcctaatggaggtctagtgtattcgtttcagtcctattcgtaggaatatgagttgaaatggcaaagttatagttatgttgaaagtaatgaagtaatttttatataaaactaatttattaactatcacattgtaattaattaaaacactcttacttttacacaatgttcctgtttttaaagtacttttgtgtgtgtgtgatatacatatctatatgtacatatatgtggattcccacagcgtcgtatgatacaagcagaaccattaattattatttatccccatacttatgtataatggagtttccatgaggtttaaaaacttcccctgtaacataaggatagtggatcatgaagttcataatttgtgaccttattaagttctaattactagggatacttcttgttttagtttgctagggctgccataacaaagcatcaagatttagtggttaggccaggtgcggtggctcatgcctgtaattccagcactttgggaggctgaggcaggtggatcacctgaggtcaagagctcaataccagcctggcccaacatggtgaaaccccgtctctactaaaaatacaaaaattagttgggcatggtggtgcgtgcctgtaatctcagctactcggaaggctgaggcaggagagaatcgcttgaacccaggaggcggaggttgcagtgagccaagatcgtaccactgcactccatcctgggtaaaagattgagtggcttaagtgatagaagtttcttttctcacagttttgggggttagaagtctaaggtcaaggtgtcggcagggctgactgcttctaaagcctctctccttggtttgcagacggctgccttctccctgtgttttcacacggacttccctctgagcatgtttatgtcccaatttcctctttcttataaggacaccagtcgtgttggattagggcctaccctaatgacctcgcttttgcttaatcacctctttgaagatcccatctccaaatacagtcacattctgaggtactggagattaggacttcaatttatgtattgttggaggataaaattcaaccataacgcttgtgtaaattgtgaagaaaacagtaattaatgtatagcttgttttaaattttctgagtgaatgagttaaagaggctatatgaaatagtaagtgctattttagccaagaaaattatgtctcagcacatgtggtttgtgtttcaaaaatatttcttgagtaaaatgtctgatttatctaatatttttaataatgctataacctttactattttgataatggtagtactacccgacatatattgagtcttaccatgtaccagactgttttaaacatatgccctgtattaacatatttaattattacaagcaacctatggaatactattattgccctaattttaaaaatatggaagctggccaggcatggtggttcacgcctgtaatcccagcactttgggaggccaaggcagatggatcacctgaggtcaggagttcaagaccagcctagccaacatggtgaaaccccatctctactaaaaaaaatttaaaaaattaaaaaaaagagagtaaactctgtgtaagaacgctaaatgacttgtcaaaggttctacggcaattaagtagcagaattggaatgaaacccaggttctcaggctctggaacttttgattagcaggccagtggttctcaatgggtggactctagtttctggctaagatggagtaagaggaaaagatttaccatccaatgtagaacaactaaaaaatgtatctaaatatgtaaaacaatggattgtaagacattggacttcatggaatgaaaggcagtgatccctgcgaggaaccatatagttgccccactttataatcgagagaaagagttcccaggcttgatgctcaggaaggtgatacctgacccctgcagcctgcagttggaacacagcactgagagtccagggagaccaatgcaatcagagtacagggaagaggacaagagtactctgcacagggagcgagaaagagcttcacagacagtcagagggttcccttgaatcatcagaggaaaacagattagtatatacatgtgcagaaactagccatggctggggaaagaactaccgaaggactagagggaacaattgctggaactcatctggggctggaatagttcctgtccccaaatcataactcatgggacattgggtagaatattcagaagaattttgactcggtggggaaaaattagccctacactaaattatgctagttccaccttaccaagcttaaaagaaagacctgaaagggtcaaactgtttccaagttgaagaggaaagggaataaacattcacgaattactgtcatcatcgtgaagggactctggatgtgaatcagtagctacacaagaaccttcagtgtctctgagcatgggaagatgaaaagatttgcttttcatgcaaggaatttaaatttccaatgtcatatatatgaggacaaaatacattagtgtctgagtgttcccagcacttctcctcttcaccccactgaaaagagtctatccacccagattcttcccctccacagctcttcagagagggttctgctggccagattggttcagaaagaaggtattaagaattaccagctgggtgtggtggctcacacctgtaatcccagcactttgggaggtcgaggcaggtggatcacgaggtcaggagatccagaccatcctggttaacatggtgaaaccccatctctactagaaatacaaaaattagctgggcatggtggtgggcgcctgtagtcccagctacttgggaggctgaggcaggagaatggcatgaacccgggaggcggagcttgcagtgagccaagatcccaccactgcactccagcctgggtgacagagcgagactctatctcaaaaaaaaaaaaaaaaaaaaaaaaaaaaagaattaccatgtgaatgatgaacacttcccagtgtttgttgataactgaagtaaagaccttgagatagtgttggaattactgtttggttgctgggtagtatttgtttacctctcacactactttcagatgggctatgttagtcatagctttaaccagattatagatttactgattggatagatgtttactaaaaattaagtgagcaaatgcaaggactagaacaacatagacaatatattctgatttttatttaaaagaaatatgcaaaaaacactataaaattttaccccaaatatacccatcagtataccaaaagtgtaccatgtatgctaacagccatataaaattactaaaaggatatataccaagctattggtaaaaggttatctctttcactggggaccaggattgggcaggtagaaggcagtaggaacatagcaaggagatcctttcactttgtattccgtatattgatgagttgcttgagttaaataaaacaagaattataatttgtcattaaaaaactaaatattaaaaattaccatcttcccagtgtttgcaatttttttttttttttttttgagacaagtcttgctgtcaccaggctggagtgcagtggcgtgatcttggctcactgcactctctgcctcctgggttcaagcggttctcctgcctcagcttcccaagtagctgggactacaggtgtgcccagttaattttttgtatttttagtagagatggggtttcaccatgttggccaggatggtctcgatctcttgacctcgtgatctgcctgcctcggcctctcaaagtgctggaattacaggcatgagccaccgcgcctggcccaggcttcaaaatttttaaacatttaactggaatagtaagtaaccaacaagcacttagaaagtgcctagtgtttatgattcctgccacctcagagagctacatttgtgttcaatcttcggacacttaaatgttttcaatgtatgtaaataattattgttaagattttcctaatttctttgttaaaatggttcatttcaaggttctttagagcttgcatttatttcattttttgtcatgtttcttttctcttagaataaaaaccagcagtcattttaattacccctgataatgttcatgaatactgccttggcctgtcttctggtttggaaccttttcaagggcgaatggatatttgtctggtgttccatgtataacctgtccttgtgccacttttccaatgtggcaggaagggaacaactgtcatctgttctgagaattcagcactgtgtctggcactgtgggaatttacccagactgctttgggggaagacatctgacacttcatgataattgtaattaaccagaaagacactggaattggaggatttgaagggaaatatgacaagggattaagactttgagattacttttggagccagggtgacttaagcacatttaaaaagttaggtttacttatatattattattatattctaaaccataagacattttctaataaggtttctaagaggaacatgtaaacctggatcaaatttaaataaggttactgaaaatattaatgaaaccaatgactgagcattttataaatgagaactgtattgctttaagttggagaaaagctgcaagtaagacaacatatttcttcatttgaaagcttgtgtccttatatgagggacattgacaaatgagtggtgataaaatggtggtctatgtgccataagggcttaggtacataaattaatgttttattaaccataaaaataaggttaaaaggttgaaatgtagccttcatgtgtctatgtaaaaaagaggcagaaaaaaatcctcagcactctagagaagcttagtctctgagcaatcactgcatatactaatatattcacatataatctagaatgaatgttaaataacaaaaatcatgttcgtttttatattttgctttgcctttgggatacgaagtgatggaacgagctcgttaacactgctcatttctggttagaagaacactagaaccacctagtggatttttcatttattgcatgatccctacactttactattgctaaattgttaattgctgagataggccttaaagtaaaatcagtggttataatctctttgtgggtcataatagaaatagtaattgttaatcttcagcagacaaagctgtccctaagtccttgaagggaagtccctgcccaccaaatacttaccaactagcacactgctgcatctagaaaagcacaggcagagttaaacatttggctgctgagatacaccgtgcaactggagctttaaatttcctgtgaaagtcagtgagcaaggtaaactgcagcaattcatctgcattcatggcagagtcaactttcggtgagcaagactagggaactctgcagagcacagccaaggggctacattagcagcttgacctttgtattcaatataaatctgtgggcacacaaactggcgtttctaatcaattttgtttttggagcaaagtagcttatgtggttacagcgtgccctggtcattctgtttcccattgctgaaccaactgggtctccgcatcttggtggtgatgacagatgttacgtatattacattgggatttgggtcagataaatagcaaatattctgggaaaggatactttatgtttttgcaaaaggttataaaataccaaactttagtaaaccctgattctaggccaaaggttaactctttatatctatgatttattaggtatcaaaagaaaaaagtcaggatctaaggggaatggaaaagtttctgctattctaacctaagagctggttgtcttctcctagtaaactaactgttcagcagatgggatgcatcgggctacaaggttggtgctttccagccggcaccgcgtgtgaagggcatgtggttgggctgggctctccaagtctgcatggcttgggttgactataaccaggggaaacacgcagtggctacaactgcttctcctaacaattctcgtttcattctcttctcccacagtgtgaaggaggctaggtggatattctctggggcttgaaatttcacactgcaaattttacgagagtgatgatctcttcctaactctttagaagccaagataggaaaaatttcagtttacaagaataaagcccaatccctcttcttatgttggaatgtccagtaaaatgctaagaaacgggtgggtagaagaagaggaaaggaagaagagaaacagagaggagagtaaggaaaaaatagaaaaggcagaaaaaaataatgtacatgaacaacaacaaaaatagtgacaaacagaatggactatagagataggggagggtagtgaagggcttcagagaagtcaggtgaagggccttcttttcttttctttttctttttcctttttttttttttttttttgagatggagttttgctctgtcatccaggctggagtgcagtggcataatctcagctcactgcaacctctccctccgggttcaagcaattctcttgcctcagcctcctgagtagctgggattacaggtgcccaccaccatgcctggctaatttttgtacttttagtagagacggggtttcaccatgttggccaggctggtctagaactcctggcctcaagtgatcctcctgccttggcctcccaaagtgctgggattacaggcatgagccaccgtgctcggccagggccttcttttttaaagaaaattttattatgctgtgataagaacacaacatgaggtctaccctcttaaaaattgtgtgcataatacaatactgttaactagaggcacaggttgtacagcagatccctagaatttattcatcttgcataactgaaacttcacccctgttgattagcaatttcccatccttgcaccccagtccttggtaaccaccatttattctactctcgcattatgtgaaatggactattctagatacctcctcaaagtgcaatcttgcagtatttgttcttctgtgactggcttatttcacttagcataatgtcatcaagtttcattcctattatatatgtcaacattttcttctttttaaaggctgaggctgagtaatattccgctgtgtgtgtgtgtgtgtgcgcgcgtgcatgtgtgtgtgtatataatattccaatttacgtattcatccattgatgaacattttggttatttccacatcttgttttttttgaatagtgctgcagtgaacagtgggatactaatatttctgagatcctgattttagttttttgtgtttattttttttgagacagggtctcgctctgttgcccgggctggagtggtggcgccatctcggctcactgctgcctcaatctcctgggctcaagtgatcttcccacgtcagtctcctgagtagctgggagtatagaccaccatgctcagctaatttttgtttattttttgtagagacgaggtctcactatgttgcccaggatgatctcaaactcttagactgaagcgatcctcctgtctcagcctcctaaagtgctgggaatataggcatgagccaccatgccaggccccagtttcagttattttagataaataccgaaaagtgggattgttggatcatctggtagttctatgttttcaatatttttaatttttcccagcttttttgaggtataattgacaaaaattgtatatatttgaggtatactatgtgataatttaagttgtgaaatgattaccacaatccagttaattgacacatctgtcatctcacataattaccatttgtgtgtgtgtggtgagaacatacaatatctactttctgagcaaatttcaagcatgcagtatggtattattaaccgtaattatcatgctgtactaatattggatccctagaacttaattcatcttacaacagaaagtttacatcctttgctcaacatctatttctcctacctctggatctctggtaaccaatttctactctctgtttctaagagttcaacttttttagatttcacatataagtagaatcagacagtatttatctttcttcatttggcttatttcttttagcatgatgtccttcagattcatccatgttgttgcaaatggcaggattttcttctttttttaaagactgaataagattttctttttatgcatacatattgtctttatccattcacctgtgatggacacttaggttgtttccataccttgactattacgaataatgctgcaatgaccatggggatacagatatttcttcaagatacttatttactttcctttggatatagacccagaagtgggattgattttattatatagcagtgttgttcttcactttttgaagaactgccatactattttccatagcaacagcaccattttgcattcccacaaacagtatgcaagggttccaatgtctccacaacttcaccaacacttttctcttttcctcggagctttttgtctgttaaaccccagcttcccccagcctgaagcatagttgacaaagattgtatatatttacagcgtacaacatggtgttttgatatatgcatacattgtaaaatgattcaatcaagctaattaacatagccgacacttcatgtacttatctctctttttttttttgtgatgagaacattggctttttgatagccatcctaatagatgtgaggtgatatctcattgtggttttgatttacagtttcctgattaggtgatgttgagcatcttttcacattcatgttggccatttgtatgtcttctttggaaaaatgtcttttcaggtcttgagccccgatttaattaggttattagtatttttgctcttgagttttaagagttccttgtatatttcagaaattaaccccttctccattacatagtttgcaaatgttttctcccattctatggtagtttttttcattctgttgtttcctttgctcacagaagcgttttagtctgatgtagtcccatttgcgtatttatgcttttgtcgctgtgctcttggtgtcatatctatgaaatccttgccaagatcaatgtcatgaagattttcccttatgctttctcccagtggtttcacagtttcaagtcttacatttaagtttttaatctacttggcattgatttttgtgtacagtgtaagatatggatccaaattcattcttttgcagttggagagccagttttctcaacactatttgttaaagaaaccatcttttgcccattgtatattcttggcacccttgtcaaagatcaattgatcatatatacgtgggtctatttctgggctcctgattctgttctattggtctatagtctgtctttatgccaataccaaagtgatttaattatggttgctctgtaatgcattttgaaatcaggaagtgtgatgcctctagctttgttctttctcaaaattattccggctactcaggggcttttgtatttccatataaattttagaattgttttgcctatttctataaaaaatgccatcgagattttaataggaattgcactgaatctatagattactttcggtagtgtggatacttccacaataataagtcttgcaatccatgaaccaggatgaagggcttctatatatagggcatcagttctcaagattggctgctgggcttctcagagcccatgaagataataatgagacactgttagttaattttaatattttaaagtttgatattctatcttttaacgtttacaggaatttgaaattgtatatttatgtgtgtacctatttgtttcatggctctatgaaggcaggaccatgtctcttttactcaccacagaacaactagcaccactgttgtgcagtagagcctgatggttagagctgcacgcatgggcagacctcccggtttgccatcctgctgcgaccactgactaccaatggcacatataccaccaattggctaggctaacaaacattccaagccccattttgccttgttgccttccattatagaggcttgtacaagaaaaaaaaccctacattttactttcccactctcatgctgctgggggatggtcaaaggacacagacttggccaatgaggggttagcagaaagctggcgaaggattctggaaaggctttgaattcctgctgaaaaggaaaaatgcagttgacagatgacactaccctctctcttcttaacttaaacgtggatgtgatgcttggatataggtccgccattctgtgcttctgagggaaagagtcagtcaattctcagagggagcagctctaacaccgtggagccatggaatgaacactaggaacaaatgacctcccagctgattgttatatgagagaaataaatgtccatttgtttcagccactgtacatagggctttctgttctttttcagcaaaacgctcctattacagcagttttgtgacttcaagcaagttactttactctgttttaatgttcccatttaaaaacagggattataccaatatcgtcctcatagggttgtttgaaagactaaatgagataatatacgtaaagagcacagagtaagcactagatagggataaattactatttttattactattttgatgatgggctcttaataagtcttagatgaataagtggagtaggtcaaacccaaagggtatggcttcaacccaaggcaacccaaggcaacccaagataactcatttttttctgtttgagaaaaatgagaaagggtggagaaatgagaggaaggtggggtgcggggaaggaggcagggctaaagtggagccaggtgggtgctgggtgggggggaaaatgccctatgaaaatctcccatggtgaatggtcaatgtgttggggccaacatattggccatgtgtggtccaggcatgccagtatcaacagacactaaataaacattttttttttttggctcattgaataaatgaatgcattgtgagggtgttcattaacaaagaaattgccatctcatccttaaaactgaagagatagaagtgagagggcagaaggtttttctccagtgtcactcgcacacctattataatatttgcctggaattatgtgggtgaagatgcattgctcaataattgcctgtgccctcgcaaggagcagaggagaacatccggtgggagcagaagcagaggcagaaagaacagatttcccacggagtaaaatattctgttctcataaaaagtcccttgctgtaacaaacgagaaaatgaaaaggagagcctgtagaagagaggcagacacctcttaataggcacatctctccaaagtttcccaccaggggccaactgttcattaaacagggaacaaatgcgggagcgtagctgtgatgggctccattccacagcccagtgctgggactgcagtgcgctaggaagggcgtcgctgttgttgctgtggcccggtgtgacagcaggtctggcatgtcagaatcgccctgcacaaatagctcctgtgcagctgctctcacccaaacctgctctgaggaggctcagtgcattctaatccttcctaaaaacatggacagaaagcaatggaaagttgacatgtataaaaggtttagtcatggggtttttaagtggatgcctccatgaaaggatcaactcagatggccacgtttctgaacattatttacatcaaaacctgacataaatgcctcagatctagctattttcttcctctatcctctttttacatgtctccttttccctctcgattgctttagcttgtaacctgcatgcgctttcaaatgtggtaagcaaatagaaagcaagacgccatttgaatagtgaatggacttgtattcctgtttaggaatgtgtagttgcccttgggctttctcagttataagactcataaaataaaaccttaacacagatggaacacacacacacacacgcacatgcaccacttaaagcagatgtgagtcaaaaacatatgctgatgaactcaatttgctgatggcattctgagcagtgagcccactcagtagggctgaagggttggcatagcaactcttcctgggaaaaaatagacagctggaataaaccatgacgatgaaagtcttcttccaatgactgaagaagtagagagaaattgccatctcttctaaccccttcaagcaaagcaccttggttgaggtttatagactaggatcttacaaattagaagttcatgtattttcctaggtcagattctataccttgggttatattccagctaagaaacactttcagataggctgcatggggctgtggggaaagagagagcacaaacctccaaaaagcatggagctttgaccaaagtttatttctgtaacttatcctaaggctatgccgagtgaagacttgtttactctagctgtaacttactccatcacatagcaccattactttgagaaattaacatattcattctcaattatttatcaagtatccagcactagcaatagggacacagtccctgcttttgagggattcatgactaggcagacagcaccctgagtatattaattaagatctgatcccatattagaataatatgcacaagagacttattacctctgtctcctcattcctataaacatttatctgggacctatcttatgtggactgtgctaggtgcaatgccaagggataaagcaagttaaatggcaacagtcctattcgacaggccagggactcaggatcagactcaggaccctttccctcttgttgcaaatcctgctatgtgtgggctcagccccaaactgtctctgaaatctcagaaatgagcaaaggctaaggatgtcaaattggctttgagatatgcctgtagactgataacaatagtgatgatgacgatgatattagttaatacaataaagctaatactgtgctattattaccaggcactgttctaagtactttaaataacttatttcatatactcttctgtcatttagtatgcataccattattctccttcccattatccatatgaggaaagcaaggcactgagttaaaacgactcacctttaactgttcatctatcaggtaagctaaccccggagcctacataaattcttaactattaaataagctatgccacttctcaaccactctgctgaaaactatacaaactgacaggtcctacaattaaaacccaaaatagatataataaagcataaaaaatcagttaggaattttctcttgcttttgctctgctgttattgttgttctccagataagtcccattttaaaatccacagtcaccttaaggatgtgatgtgggagctggagctgtctgcctacccaccagctatttttaaaggaagatgatcaggaactagttatgaaagaatcagattgtttaatctggtaccacagaacttgagaaactatagacttggtaagttggaaaatatgtaggcagaagtgatgtctctatggaaacagatgtgaagattcaagtaaatactaggcctgttggactttttatgaagatagcagaagcttttttccccacttcttcttctataacctgtttattgaggaatctgaccatggtgaggaacaagctagagacatatttttatctctagtcactgcttccaactctgctatgtcgaatctcccaactcttctagacatctctcaatgacatcttggacaggaaccatagtcacttacagtctagtccagccttatagcatatgcaactgcatatccagttcaagattttccattgctccattgatggctacacttattactcaaggatctactgtgggtgtgcttaggggtaactctttcaccttggagagtggtgtgggaatgttcttgttctagtatacttcatcccaaagacccaattcctcctgttttggggactgggagagaagatgagatggcttaatgtctcttggctttctctattgcttttgctgtctctctagcataccctagcgaccactgagactcttgtggggcagagatccacacgttatctatcttagggacatgatgggttcttcgaagtccctcatgagaggcgtgactctggctcaaacatgttcagcccccttcagctgtccaagcccccccaccctctatcagctctaactacactgcttgcatttttctttcctggtgggctgctttactggcatgtggaggagtgctgatatagcaggaagagttttgctacttcttattaagtcctgaaaaggtatctggtgggtgctgtgtttgtaataagatacttagcacctgtttcccctcgagctttgggcctaggtatcagttctcagacaaaaggaaaagtcaatttttataccctattataatgataaactttgattgaaactttggggataagaaagcatcgagatgtttctctctccttctattcctcttttctcctccctccctctctccctccttcctttgctcccttctttccttcctttctttcttccaaatagcaaccatgtaatctaaattatgaatgataaaaaagcctggcaaatcaatgagagaacttagagcaaaggaatttggaatattataagatagggaacaattttagtttcctgagcattttggttgtattaccacctgctccaatcatagactgtactttttcatgcccagaaaagacttctacaacccagccttcatagcaatcagccactcgggactttcttgcagtctgagctcaacctgtcttattttgctctgagttttccagttctgaaggcttgattactggtccaagagtgtcatttaggtagatatgctgaactcacatcatcctcgttacaaattgttatggaaaatcccaaaaatataaaagaaaaaaattttaaaaactagctaagggcactgttcacatgctgcaagatctcacggaggagaagatggaatgagtggaggatacacttgctgtgtgttcatcattgaagaagggaaagagcttgtgaaatgacccctagcagaaactcactggtgctttcaagttcagggtggcagggttgaaggtgagagttagcttcagggaagatggtggagaagaatgtttgctagtatctggaccccaaaggattacacaggatgctggagcctgcatgggctaggaataccattagttcaatcatggtctacacttggcaaggaagatgcattgagaataggtgaagggcatagtcaagaccaatgctaactgtcattccttatggaggaattatggaatctacttcaggctgccatgaaaagcaaagcagagaatctgttgggacaactcgttcagcagcctcagactacagctgcatctttacttatctaggcctctagatcactcagaagtaaaggaaaatttaaacaaatctaaacattctcattctttcactggggtcttcaaagttttgaacacaatctctcagaagaatcaatttctgatacctgaatctttgtaagcacgaacagagagaagggactggacagatgaaaaggatttgtagttcaaagaagagggccattgtggggaactgatgctgagctctcggttctatgccccccagacttccttcttcagttacggtccctgcagaatcagcatccatctgcgactctcctttattcattgaactccttgttttggagaggagaggcatattttctactttatgtagctctccagcccatgatctcctgtggtcaggggctaaggattcctttccctgtttcctagtaatgcataactctatctctccataaggcagggtgggccaggcattcagaaagttggggaagctaggcagaatgtgaaataagtgaagggaattgaagggtgctggaaaacctcccatcaaaatttcctcccccatgttattccaccattaggtaattagctccctggttcttaaaggattacatcacttttctttgttaagagttgagtcatctatgcaaaaaaaaaaaaacaaacaaaaaacccaaaaactgagtgaattaaaaccagaatccttattagttattacctcaggagctttaacagtgtcccacttcaattagagcaaagctcactgggaatgtgtgtaggataaagaagatgttggaggtaatagacattaaggaaggggccaggagcgtggagggaacccaagagacgtgggaggatctcaaaagtgatctttgcctattgccaactgtgactgaggccctggcccatcatttgatgttctctgtcattcttgggagaggcagaggagtgtgatgattaagagcatggactctaaagctagacttctgggttcataaagggtaacagcttagctctgccccttcctaccttggggactttgagcaaataatttaaccgctctgtgcttttttcttcatttataaaacaggagtaatattggtccctgcctcaaagggttgttgtgaggattaaaggagttaacacacataaaatacttagaagagcacatggcatagagtaaatgctagttgttattagtatgctttcaatttcacaaagggacttaaaaggtcagaacccttacttactcctaggaaccactggggaaggagtgaggaccaacatatattgcatatgtatgccccagatactgtatataaaatatctcattgaaacctcacatattgatgaaataggtattacaatatccctattttgcaggtgagaaaactgtgtctcagagggtgagaatctggcccaaggtaatacagctaaaaagtggtaaagttatctatgatatcccacaatgttacttacacagttctctttggaaataaaaatataaacaaatggtacaggcagattaagaacaactccagcattattattattattattattattatttttttttgagacagggtctcactctgttgcccagattggagtgcagtagtgcgatcatggctcactgtagccttagcctccctgggatcaggtgaccctcccactttcaagtagctaggactacaggtgtgagcttttgtttttttttttttttttttttaatagaaacagggtttcaccatattgcccaggctggtcttgaagtcctggcctcaagtgatccacccacctcggcctctcaaagagctgggattacaggctccagcatcaaatgtttacagtagttgtcctcacagaaaatgcatacataactcttatcttcctgactcaatgctcaccttcacctcccaccctgactgcagcctattatccctgcagtcagtggacttttaatccagataccttggctgagcaggctcatagaggaaactggcccacagaaactgtgagaaataaatgtatgttgtttgaagctgctaaatttgtggtaatttgttatacagccataaaaacgaaaagaccaaacagtcatatcctgaatgattaaaaattggttgcataagtaaaagaatgtatttgagttggaagatttggggttttcacatgaaaaaccaagtgtgagtaaaataaccgcagaatagctattttggaattctgatactcaaacacttgctagttgaaggagtgctaagattatggatataacaattgattctagggtttcaaaacttatttcccataacataggaaagctgaaactctggctataaagaaaaggctatttttctttctcttgaaataatttgtactattcattgcactgtcaatagccaagaacatgctagaaattacaacgtgctcgcacatatgggtatttctgctatgatgcaacatatatgtttctaaaattcattttgttttgcaaaatcaaccaatagaaaaacaaaggacttataagaaaaatagggttggggcacaatagtcacaaactgtcagtaacacaaaacaaaaagataaaatctaatcaaattgtggtagcacagtcttacacaagtcaaatgggtaagaaatatgtaaatactacaaaaataagacactttcctttgacaaagactttacatttgcttgtggaagtgggagtcagagcattgcagcttgtgagtttttgtgaaattgtggaaggaaggtgatttgaaatcaagggaaagttgtatcactgatgtggatggatatggcccatgttgagggtggtggactgaggtagctgacatgtttcaggtacgtgcatgtctgttttgtacatcttacctggctgggttcaggtgtgtgcaattttctgtgtttccctagtgtttttcatagactaaacagtgcataagcaaccccaaattcgtgttatgctcaaaatgttctctaataaaatcttgtgtcttgaaaacaagtgttaaaaagtaaaactgaccagatgttatttcatttgaatcttacgataaaagcaataaatagacatgaggaaacagctttagacatagagctagtaaacagtcaaggcagattgaactgaggtcttcctcctctgtgcttttcccattaggccactccaggaatgtctcagtctagcatattttaaatctgtgtgatgctatagtttcactactgcaatttctaagactttatattttcaattagacatttattttactaccaagaagtatcctgatccagaggtactattctcccagccatggagagttcctccaaaagacaaaattctatctttgctaatgaaaatgcaaataaaactgtatcaagagtttcatgattttactaggtatttcccatcatatgtttatcatacagctcaaaattgatgtcaagttttttactctactcttttctcaagttcattcactataaattgaatttcatttttctgcacttgggttgtattttttgaaccactgactttgcttatattagttttactatgatattcatcaatttgtttaaaaaaattcagaagatacctcttgcacaaattcattttataatttaagaactcacttcagaatgttgagactctgttaagtatcaattctaggattatgaagatcctgtctaccacaaagagccccacaaaggtcttttctccctcattcccaagcagtttaacttaatgaattcttctggtagaactttgtttagacggacttaaagcaggtaagagttctttttaaaatacttgtggagtgcatgagtgtgcaaacaaacttaaaagcacatattggctcaggaaagctgaggggaaatgataattttcaacagtccaaaatagccatcctggggcttacagaaagtaaggtagcaattagcctaactctaagcctaacaataacacagtcattaatcctgggtgcccagacacattccattagaggattttggcaacaaaattttgcttttctaattctgagtagatataaacaataatcccttaatttattagtctgtttatcacacttattaagcatttcctatgtcttaagaactgtgccacaagacaaggatgccctctcttaccactcctattcaacataatatgggaagtagacataaacaataattccttaatttattagtctgtttatcacatttattaagcatttcctatgtcctaagaactgtgccacaagacaaggatgccctctcttaccactcctattcaacataatattggaagttctggacagggcaatcaggcaagaggaagaaataaagcgcatccaaacaggaagagaggaagtcaaactacctttgtttgcagatgacatgactgtatatctagaaaacctcataatctcagtccaaaagcttcttaagctgataaacaacttcagcaaagtctcaggatacgaaatcaatgtgcaaaaatcactagcattcctatacaccaacaacagtcaagctgagagccaaatcatgaactctcattcacgactgccacaaaaagaataaaatacctaggaatacagctatgtagggtggtgaaagatgtctataaggagaactacagacttacaaatcactgcccaaagaaatcagagatgatacaaacaaagggaaaaacaatccatgctcatggataggaagaatcaatattgttaaagtggccatactgtccaaagcaatttatagactcaatactattcctatcaaactaccattgacactcacagaactagaaaaaaactattttaaaattcatatggagccaaaaaaagaaaaaaatccagaatagccaacacaatcttaggcaaaaagaacaaagctggaggcaccatgctacccaatttcaaactatactacagggctacagtaaccaaaacagcatggtagtgacacaaaaacagacacagagaccaatggaacagaacagagaatccagaaataagactgcacacctacaactatctgatcttcgacaaacctgacaaaaacaaacaatggggaaaggattccctattcaataaatggtgctgggataactggctagtcatatgtagaatattgaaactggatcccttccttacacgatatacaaaaactaactcaagatgaattaaatacttaaatgtgaaatcaaaaactacaaaaaccctggaagacaacctaggcaataccattcaggacataggcatgggcaaagatttcatgatgaagatgtcaaaagcaattgcaacaaaagcaaaaattgacaaatggggacaatttaagctaaagagcttatgcacagcaaaagaaactatcaacagagtaaacagataatttacataatggtagaaaattgtgcaaagtatgcatctgacaaacgtctaatatccagcatctataaggaacttaaacaaatttacaagaaaaatacaaacaactccataaaaagtgggcaaaggacatgaacagatacttttcaaaagaagacatatatgtggccaacaatcacatgaaaaaagctcaacatcactgatcattaaagaaattcaaatcaaagccacaataagataccatcttacaccagtctgactcttactataaagttaaaaaataacagatgctggtgaggttgtggagaaaaaggaacacttatacaccgttggtgtgagtataaactagttcagccattgtggaagacactgtggccattcctcaaagacctaaagacagaaataccactcaacccagcaatcccactactggttatatacccaaaggaatataaatcattctattataaagacacgtgcacgttgcatgtgtatgttcattgcagcactattcataatagcaaagacatggaatcaacctaaatgcccatgaatgacagactggataaagaaaatgtggtacatatacaccatggaatattatgcagccatataaaagaatgagatcatgtcctttgcagggacatggatggagctggaggccattatcattagaaaactaacacaggaacggaaaagcaaatacctcatgttctcatttataagtgggaactgaacgatgagaacacatggacacaacacacactggggcctttcggagggcagaggatgggaggagggagaagatcatgaaaaataacttaatgggtattaggcttaatacttgggtgatgaaataatctgtatgataacccccatgacagaggtttacctatgtaacaaactcgcacttgtacccctgagtgtaaaataaaataaaataaaaagaactgggtgccagatgttgaaggaaaatagtaagatcttaagaaaatggctttggccgggagcagtggctcatgcctgtaatcccagcactttgagaggccgaggtgggcggatcaggaggtcaggcgatctagaccatcctggctaacacgatgaaacaccgtctctattaaaaatacaaaaaattagcctggcgtggtggcaggcacctgtagttccagctactcgggaggctgaggcaggagaatggtgtgaacctgggaggtagagcttgcagtgagctgagatcacgccactgcactctagcctgggtgacagagcaagactccatctcaaaccaaaaaacaaaaaacaaacaaaaaaacacagcttcaagtttgtagatctatggtcattcagtctatgacactgaacacttcctttagtagctcacttgttgaataacatctagaattaaataggagaaaaaattttcctaatagaactataccaggctttacatgattggtagtcttcgttcttcacaaaccagtttattttaatagatatctcaggtagagttttatgaaggcctcaaagcaattaaaacttcatttgcaggaaggacaatcttatacttaccagaaaactacagctaacatgaatttctttgttagacatttgctatgaaggatctttgagaaaattctgtgttagaacccatgacacccctaacatagctatgccattatttttttcttcttaaatgaacagatgagttttgtaagcaaagtaggataccatgattgatagacctttttgtaaagtatactcagatttgctgaaagagcctacataattcagtctgggtgcagtggctcatgcctgtaatcccagcactttgggagactgaggtgggtggatcacttgagatcagaagttcgagaccagcctagccagcatggcgaaaccctgcctctactaaaaatacaaaaattaaccaggcgtggtggcacatgcctgtaatttcagctacttgggaggctgaggtaggagacttgcttgaagccgggaggtggaggttgcagtgagccgagatcatgccactgcactccagcctgggtgacagagtgaggctttccctctctcaaacaaacaaacaaacaaaaaaaacaaaaaagaaggagattacataactcaagaaaaccatactcgaagcctctctttttaaataatttttatctcaaataagggaaaaatcaaaatggaaagaggttatgatcagtttcaccattggcctacagtattgcttcagagaacaaaataaaagggttcttgcctctccccttgctggaactgggcctgccccagggacttggctgtagggttgcaggtactttccctgtcctttgatcttaatcaccaagggagcaattaaagttccatgtccaggaatcacttagtaaagagtcttgcttttagttagagagttgaaggggttgtgggcaatatctaaatatgctttggacattgtatttgatggggttgagaaataaaaaaaaaattctaggctcctaactaactgaatggattcccctcttggccaagggtgaaactgcctttgcaaaattattacacaaagagaaatctaacatagttgactccatcttgcttctgacttccaagctgtccttggtcattcctgggtgtaggccaagctcactttgggaggaatttagtttatagttttaccttaaaacaaagatgataatagcccttctcaaaactaaatcacctttgtaaaactaatggaaaggcacaaggttaaaattatgagagaggcccgaattctgataggataggcatagtttttatcagcccttacagatcaggaatcatgtgaccagaggtcacaagatttgtgaccttcccatttactcctatagttaacattgctatgttagaacccaagattgtattttgtgggggatgttttccagactgatcctacctgaacttgtgattcatgactcaattgatcctatggcctcacccagaggtagactcagcatacgaagactgttttccataccagtatgattccatccctaaccaatcagtggcacccattccctagccccctgcccaccaaattgtccacaaaaaccctaagctccaagccttcagggagactgatttgaatgataactccagttctcccacgtgagttagctttatatcaaatgaactctttctccactgcaatactgtggtctcagaggattgatctggtctgtgcagtgtacagtgctgggtgattaccagagaaactcgggaagctgagttcatggccttggcgggatgggaggttgaactagtctcactagtatgtaatcacttgtctcactgctgtcccctccccaccttttttaaaggaaaatgtacaaatagtaaacttcctgagaccctctttggaaaaaacagccatagatgcatctgtgacttatgtttttcctggacatgccctcaagctggctcgataaaccttgatgactgagatttatgactcagtcactcattttgattgtcacagtataaagggcctgctatggtctgcatgtttgtgtctctccaaaattcacatgttgaaatctaatctcaaatgtgtgggcattcagaggtggggcatttacaaagtgatgaggtcatgagggtggagcccttgtgaatggaattaatatccttctaaaagaggcccaagggagcttgtttgccccttctgtcatgtggggacacatagtaggcaccatctacaaggaagggtcctcccccagacacggaaactactgttggtgccctgaccttattaattatgattgagacaatcaaatatggtctggctaagagaagaatagtccataacattttgatgctgactccctaaagtctatgttttgaaatattgaatatttaacatgaagagcaaattacaattaggacgtcttaggtccatacaaagtaatattctatggactgcctttggaattactaggtttggtcttgggatcagattgaatgaactcagtatagattctgtgtcacttctactcatgaaacacatttactgatggttaatctaagagtatctttaggctaggtacagtgcctcacacctgtaatcccagcactttgggaggccaagacaggcagagcacctgaggtcaggagttcaaaccagcctggccaacatggtgaaaccccatctctactaaaaatacagaaattagctggatgtagtagagggcacctgtaatcccagctactcaggaggctgaggcaggagaatcatttgaacccgggaggcagaggttgcagtgaactgagattgcgccactgcagtccagcctgggtaacagagtgagactccatctcaaaacaaaaaaagtatttttatatatggcaacatgttgctatatagttatgaaataaagtgttgacaaaacttgactgaatgtaatcatagtgaagccaacgttatgtgtcatatgtcacctgtgcctgttttgtcacaagtgctctttacaaaccacttagcatcttcactttgaggttgtatgctcttatttaatgctccatagagttttgagattgttgtgagttttctattcaacattggcttctccaaagatttgatcattttttaaaacagctgtaaacctattcaaaatttatataacatatatttaaaatataaggacgctttctgatttcaaatgcatctcatgcagttaataaaattggtaattggtaatttagagtcacagataactctaagtaagtcaattaaaactgtgtaagaatttgaaaagaggatacagggcattgaggggattgacatttggtggccaagtcattatagctattgtttggaagaatctgatgatattcaaatgatcaaagcaagtattttgaagaaataaatgatgtgaaataactgataaagagatactttaaactgacattatcctacacttaaatataataaaaatacacagtaataaagcaaaataacagatttgttgtttggctacaacatcaagtcattctcaactacatattttgacaatagtgactctaaatattttctcaaactaagctttcctaaatattttcccaaaccaagctgtttctttacggactttatatgcattaattttatatgaatgactatttttctaacataaaaacaatctttacaaatattttgagaattcaggaataaaactaaagcattcaaatgaccactgctcagttgtacttgagagattttgcccaaaattatttaaaagtgttgaactgtagaaggccttaaaatagaacttgtagaatttcaatattcagaaagtaaagtttgttactatgggtcatactgttgtgaaaaagcagaaaaagaattcagaataatcaaattgaaactattttgctgatataatcaaatatgcctgatgtttgttgtggttttaaagactgtattttctctttggacatttctccatctttctttttttttttggtgtaaaatatacacaacataaactttccctttttaactacttttaagtgcacagttctgtggcattaagtacatctacactgttatgcaaccatcaccatcatccatctctggcactttttcactattcccagttgaaactgtacccattaaacaccaacttcctatttttcccttcctcagcagtcaccattctactttctgtctctgtagattgactactctaggtaccttgtacaaatggaatcatataatatttgtccttttgtgactggcctatttctctattgttttactaacataaaagtattttatctgttattaattttatctagtcagaaactggaaacactgacagaatctttggctgattaattacactacaattgacaaaatactgcccaaacataagtgatttactaaaatatgggacatgatgtttaaaattaaaaacctgatgaaactgtagtgtcagtctcaattgcagttgtaatatttttcctatagccaatgattaaaatgtgcatttgttagtgattttaaattaatttatattaaatttactattttcccatctaaagcagaattaattggtcatttttttggcacatgaattaaaacatatatacactgtctttggtttgctaaaagaatgaatgaatgatataaaggcatctcatgtagaaagatttgttcttgttaattagcaggtttattagaatatggtttctttcatctgaattttggagattggaaaaacaatctccaaaatataaagaatgcagagaagtgcaggagaagagagaatggtaagctaaaaattaccatcaaatgctaagtgtcagacctacacaaacacaaaatttaacatacttaacagtggcatgttcagtgaatatgagcaggagacatgagctcaaatctaatgatatctatgatgccagaaactttgtatatgctgaatttaatccttatgacaactctctgagtcatataatttccccatttttgcagatgtcaaaactgaaggtaagaaacggtaagaaatttgcctagtctcaacactagtcagtgtcagagccagaattccaattcatgtctacatttccaaagcccatgttgttcccatgacacaaaattgtagcatgccttacacttattgacttgggagagttttttttcttaaaaatatagtatcaatataattttagcaaatcttactgccattagaaattggtaacatttatttgaggatagacttcaaaatctttatgagacataagaaaatgaagttccagaataacaggaatttgaatggtagttttcacctttcagaggatggttttttgggggtggtaagaaacatctaagtattggttctcatttgggggcatgcttagaggcatcagtagtttctggtaaagtaagggtctttcaaaagaaagacaaatgaatgatactgtataggtgcagttacatcataggcaccacaataaggtataaaagtaaagcattatgactttcaccttgggaaagaactttgaaatgaggaaaacaaaattgcccaataaaggtgatattttataaccaaccagtgtggactagtggagcataaagtttctttaaagacacaaaatagctgtagcttggattgcacatgtggatacatcaaaataaatatgtgtcaatcaaaagtaatatatgagagtttctgctttggcacattctaacttggtgttatcaaccatttacatttttcataagctaaatagtacgaaataatctcatacagtggttttaatttacagttttctaatgactagtgatgtggagcatctttttatatgtttatttatcatttgagttttctcttctgtgaactgacagtgcatatgttatgcaaatatccaaccttcaatgtccaattttgaagtcttctaatagatgtgaaatttgtgtatagattcttttgaactctacctagacaacatgggagagacggagatgcttaccaaacccattctcttcttcccaggcacacagttacagcgtgtttccccatctctcagttgttttgccatgtgacggactgaattctagaaaatgtaatgtggacagaaatattgctatacctattccataaaacttcccacaactgaaccttcattgtgttttaccatttaccagctggttggagaggatcaggatctaaagggggtcacaggtgagacgagtaatcatgtgaaaggctgcacaacagagaactcccacattggactataatttgaatgggaaattaatctattgggttaagccactgaaaatttgaagtttatctgccatagcagctaatattgtcattaactaatatacactatgtatcgttgtgaataatgactattttgtttcttcctttacaatctctatactgtttatttcccaggagttgacattttattatgttttgtttctttcttttcacttccccgccgtgtcacctaggaactctagttcaatgttgaataaaaaattttgaaagtggccatctgtgttttgttactgaatttcgagggtatgttgaagtttctcttttaagtggggttttcttttcttttttttagagtcaggggtctctctctgttgtccaggctggagtgcagtggtgtagttatagttcattgcagcctcaaactcctgggctcaagggatcttcctgcctcagcctcctgagtcactgggagtacaggcataagccaccattccttaagtaggtttttcatacataaacttaattaggctaagaaattttccttaaattcctagtttactaagaaaattttactgtaaatctgtattgaattttgtcagatgttcataggcttgtattaacatagtaatacatattttttggcctttaatctgttaatgtaatgaattacataacagacttttccaatgttaaactatcgtacattcctgggataaatccccttctgtttttacatattattgttgtctaatattttatataatagttggccaatataccaatgtttgctatactgcttttatatcactgttattggttatttttttcattcttgatttacatggccaatgttcatttggttttacttacatatttaccagtttctttactcactactgtctctttcttctcactttttcctttgagttcagctttcttatttctgaattacagtcttcacagttcttcagctaatagcaaagttttaaagtctttttctgacaatgccctttttcattcttattcttgaattttagatagctgggtataaatcctttgaagacactgaattctattctgaattgtattgttgttattgaaaggttcttcttcttcctcctcctcctgctcttcctcctcctcctgctcttcctccttctcttaggtaatatctttgtctttgtttcttctttagatattctctttgtctttgatgttctgtgtttcaccaaggatgcactgtgtaatggctctagttgtgagtttctttttatttaccctatttaggattcttgactttaatcaaatcaattaaagtgtacttttctcccattcttttaatattctctatgtggaattcttatgagacatagattaaacattacttctatgtctctttttaacatatctatatacctctctgtgaatatgcacacacatacacacatatataatatatatatttgtatatgaatattacatatattttgtgtatatattatagataaaagtatatatacatgtgtatttatatgcatattgcctgtgtatataaaattaatcatatgtaagtttaatttctatataaattatatataactttaatttatagttaatttaattatataaagattacatatatatatttgttgtgttttgtttttacttgcagtgccgagaattgaggtaatcatgttgctcagttcatggcacactattgttatcagtgggtgtactatttctcccttggttgtttgtttaatcattcctctttattctcatttcccacttatattttccttctcccataggaatctaatgtatttgttagaataagcaacagcacagtaccacagttgtataaattaaaatatatacccactaaagaacattatgtatttttaaagtacctatttctcactttctatattcagcattctgttttaaagatctatatatgttgctgtatatttatctagttcactgcttctaactgctgcatcttaatatataatgtgctgtcattgcatttccctgattcactcttcagtgctggaaactcagggaacttccaacttcctgctgtgcaaacaatgatcaaataaacattcttttacatgggttttatagacccttttgagaatttctctgggatgtattcctaggaattagattgattggtcattggatagacatatttgagccttatcctcttatattttgcatcttttgctgaatttgggatagtttcattaaattgatcttccagtttgtattttatatgttttaaattttctgtatattatgatgttttgacatcttaaaaaaccctttcttgctgtaaagagaccgcccttcctggctctagccaattcttagagatagcaaaggactcagttaggagcgtactttagatttgcaaattaaccaagttgtgtatcttctgtgtggcctgtacacccccagggaaaaatatgcttgtgtcttaatcatcccagggccatgtaccaggcaattagggactatctctatagtttagagcctgcagttattattcaaactaaccaattctaagaagtttatcctgccctccctcacgcttcctgtcccacggaagctccaataaaattctagttttggttttcctcttacttctgtcttctgccacctgaccaaaacctggtgattccccggtaactctgtatggcatgtggtacccccctctctagaacctgtgaaagtaataataaactttgttttcttgtggctttcctgtgtcccctgtgctgcacctgattaaccatcacctaaaagaactcagaatacgattcatacattttctcttcatctgcctctaatatgatatttttaaaatgtaaatgattagaagctctatttgaggataatagattgagaaaatgattgagcagaaaaagtaaatcaaatgagaatactaagacccttcaaaaaagatatggcagaaattcttcatgtgttttacaattttagaatgtaaactcataatttgttttgagttcatttgaaagaatcacatttgtaccagtcatgagttgatcagaaaaacggatcgtcatgaatgaaatagaatagtggatttaattagaccttgtacaattggggaactggttaagaagtccatgtcaggctgttgctttttcatgtggtatttactggacctggggtcactgtagataagctggaaggcaatcaggaatgagagttggatttgaaataggaaagggcaaggacaaactggaacccacaaggtcagacgggaaccccagaagacaaaatggagcccaccaggacaaactggaatttgactctgtctctcatgatctctaacttcaataatgttagtgacctgcagagaagtttgaacccttcatcctgaagttgcacatacacttggcccaggactgaaggaagtcaaagaaggaaatccactggaagctggagaactgtgggtctaggtgcttctcagtgtcaataaggtgggttaatagattagtgacaacatgtgcaaattgccaatgcctggtgtcatatattgagtttcagagtataaaatggtggcttcttcatttgtgcccttcagttcccagaccaatgtgctttatggcctactccaaattgagaaacacacaaagaaataaattctgagaatgtaattccagtttagctaggttgacatagtataaaaccatattacactagtttagttgaaggtatgtatctacggatatattttgtgtttatttcttttaccacccttgaagtatctccagctttggattaattttaatgtaaatttttcattttggagctttctagaccaatagccaaacttaaaatgagttacttgacagtggttctgggttctcaaggaagagtctctatttcgccattctgaacagaggctgagaagacaacttacccagttatttccctatacctatgggcatattagttcacacttacgctgttatttagagtggagtttctctaggttctagactctggtggtctctgttccaactccctataggagtagggacagacgaccttatctcctgcctcacagtggatattaagacatcagcctctagattacctaagacagcccttccccagagtagacaaagagtcagatctgggctttactgctgtgagtttcagttctctattattctctgtcccctgaagagctatttattttccttctagttcagaaatgcattaaaaattaaaaaaaaaaaatctagatttttcagatgtttttagttgacattttcaggctaactactctgccatgttacctgaacagggagtccattgcatttgcaaccaagaacttaaatgcagagacctcttttacaaggatagggtgctttagcaaattcagatttacaggaaagaaaattacaaatatacaaaacagatcaattagagggatgaatttgcataacaaaaggactcgccataggactagttaaaatagctaggatctaacagtgaatttagagcatctaggaaaatgtgcattgtataaatctatcaggcctgtagttaaagaaatgcggggatgaatccttttgtaaagcagaaagtcctttttgtaatgtgaatgagtactctctaatttacaagtctgtaagtttgagaagtttgagtctttgtgtatctggcttctcaaataatagagatccagaataagttatttatacagagagttcaggtttaactctcctgagtatgatttttctatgttaatataaaataatcaaaacaatctgcatatttaaagaatggaatcatgaggtccttcagacgtttaatatgtgcatttctacataatttcccatgggtcttgttactggaaatatgttgaagacaaatgtttccacaaaatgaccgatttcttttgatagatctatttaagcacacagtaaaaaacatcttgaccagaaacataattgctaattcactgtgttggacattagctattgagttattaaccagttatctgagggcctaccatgtgctgatcagagagtcagagttccttagatatcaggtacccaaactcttcattttccagatgaagaaactagtgatgtcaaatgacttgataaacagtttcatggctactcagaggactgcatgaaacttccagcatattatactgctttctttaatagagtgaaagagtccactaaattaaagaggttgtcaactccatggatgagaaatttatgttaaggaaccatgactcaccccgaagggtgccagactgagtctgtggcccagtgcaaagggcacagagacatgccatcagacaggcttgtgcctgcatgtcttgcattgacgttgggcaatttattaacttctctgaactgcagtttccccatatgcaaagcagaaaattaatactcatcctgccatcctgaaaatgtattgttagaaaagaacattattatatgggagatatactttactgtataaactccaaggtactttaaaaatgtcatttgttatgattattgccatagctactctagagaatgcatatatcaaaagatctatgaactttcacaaatatttttgcagaataatcaaggaacaagttgttaacctttttctcagaagcaataaacaagaaaaatctagactagatgtttatacaaaaagttatttacaattcagagctgtgtccaatgtcatttgttatcattattcttatatgagtgaattaaatattttttaaaaaattaatacatggaaagcaatcagaagaatgatttgcacacaacaaaatgtatatgaacattggttattgttaattatatcctcatacttttctattcctcctgcaattgtgcaagccaaactctctcaactctgaattttattttctattgtttgaaatgacaaagatcatgggtagctgataattcaagcattgtttttgctcaatgggaagactaagatgttgctttagggagtaaaagtatggggagacattgtaacaacagctatagtgtcaaaggacagtgtgtttttaaatgtatgtatacattatacatttattcccacttagcttctgttataaaagtcctgagacatcttctgggctttgatctgtttatggatccagatggcagagaggtgatgagaccacaggttagagagaaaatttagtcacaagattggaaattataagccttttactgcttaattattcccttcctgaatttcaggatatggtcacctatgaaggttattttacttcaatcaatccttggatgaagaagacaataaccatagctgtacaaaagaataatgagatttaagtattgcaccgatttttacctacattctctaattgctcattacctaaggcagctcagaaatgacgaactggctcctttttcatggtcaggacagctgcttttatatgttacatacttgtttaatatgaacttcaatggtttttagaagaaggaataattagaacaggtacagccaggggatttttataactcctttaatgaatactaaatagtattttatctttaaaagggaccatggctgcccttaactgcaaccaagttcattaataaaaagttttcatgcagcagacacaaaacaatataaagaaaccagagaaaaatctaaactgagagctgtagttactatctgtgctaagtgaatcaagcctacttgcaaagatgcataattattttttaataaaaaagaaataaaagattttgctggcttaaccaacgataggtaatgatactaaaaatgacatgagagtaggatgctgtatactgattccagctgcttctctttcgagttgggattatctgaattggaaaagaaaatccccatttccccagcaaggtacagattttacaaaacagagatccatccttgacatggtaaatatctaatgaaaccacctcttctttccatttttttcccaccctgagccacatgctgtatattaaataaaggactcaactttgttcgtactggagaagttgtctgggctgctgcaggatggaggtttacctgaggttacctgtatgaagggtgaattgctcacgctttagagcactgttatctttctccccatgtactccttcaacagcacaatctacagtgaagtacttgtcagggtaagcggtgaggaaagtgagagcaggttgatcaataaaacatagactggaggaagcctcttccacaggaaactaacaatgcataagaagcatattcttaacaatgtttggcaggaaactcagcagcatgaaatgtacttaatgtttaacagaagttctggaagaaggcagctttacacgtgacgtaaagaagattgactgaaggcatgctggggtctctatggaaagagatttggatgtgaatagacctgggcttgagccctggctccaccatgttctcaatgtgggaatgtgtgtgagttcctgctcctccccttcctctgctgtaaaatgggaatggtaacacctgccttaccagactataagcaaacagtgatctgagatgtgtgaaagctttgtcaactctaaagcactattaaaatgcttcaggaaagtagagggaatttatcctggtcacctgccttgggaacagtcacgaaaccataatgtgttcccagtcctgacactggcttccctctggctcaaaaactgggtcttgcaatgactggctttcttctgattttcaaggttgagtgactggcagtctgcctgggcacacgtcaaagagcaccaccacatcaactgcatggctgcagtccctgtgcaggcagcttcctttgctccccagcaagtgcaggggctggcagaggctgcttcagccttgtattgtagggggaaataggtgccacatgctgttatgaccatggtgatggtgggggcgactggtgcttctacataccctggttctaagctccttttctggatctttgtagttacacatgggagtcaacagcccactgccttccctttatcctctatctaccccattgccttcttccagcttccccccaacccccacccccgtctaatgaaaaagaagttaaattcctatcttagcatcaaatccagctgtagttttttctcccaactaagcacatgcagtacggtacctcctcctgtaccatatacctcctccagtaagatactcctgatctctttctcctcctctaggctcactttaaggtccttgttgtatgtgaccctatgtataccctgaatgtggttcttattgaactgtactataactgttaacttgctttcaattagaatgcgaactcttcaaaggaaattcttactcaccagttgtctctccatcatctagcatagtgcttggcatacagtaagtagatgtaaatgattatcgaactgaattgatcagaccctaccactcccattgatttaaaattatacatatgcaaagaagggtcattttgagaccacagtgcaatcaagatgaacatgtctctaacttctgacttctctctttctgaatccgtctaccctagctcacccatctgtctctgcaagaagggccaagaagagcacagactcagtcaaacaaagatggaacaaaattggtcacaacttgaactattccttctttattttccatttctgttttgaccctttaaaaggaatttcaaaattttactttcttctggtgctactaacgtaaaatgcctaataatctctacatggatacacgatttgaataattatacacttgatggggttataaggaaagtttggaaatcatcttacaccttctagacatattccaagtcaaattgattaaagaaattagttctttctccttagttctaaatcatatgccaggaattccaggtttgtggatttgtcatttaattgcatattattgataaatagtattaaagacctttcctgaggactcactgttctgagtggtttctatagctctgtgacagatgttaccagttggccagtaaaatccattccaatttcctctctcttgcttgttttctcctgcagagcctggaaaaagctaagacacactttcccagtctcctgcaagttggacggtggctgtgtgacatggtctggccaatgaggtgtaaacctgagtctgctggaaagatactggaagaacttttgatatcctgataaaaggaacacacatctctatcattgctccctttccccttcctccatctgggaatgcagatgtgatgacagaagctgccatagccactctgcagtcatgaggcaaaaaacacaaaagcatgaggacaaagtgccatcatgctaaggagagcacagcaaaaagacagaaaggctctggtcctaaatggcacagctaacaagtgcccatttccatgcctcttgccaaccaacacaattcatgtccttatgatttcaatccctggtggtcaggttttggtcacttgaagctaaaagcattcctaactgattcaaaccccaaataaaaacattgccctaatgatgaaacagaaattggttactttggcctcaattaaaaaatgaaatgtagctaatctttaacaaattcaatcctaaatagttctctttatgcctactgtcaggcaggcccttcttctgtggctggatctgatttcctaaagccttaatttctaactcaacatagcaaagaggtggagggaagccatcgtgcccaaaccctcatgggggtcatgacttacagttgactgaggatggcctccatttatcacatagtctattgcaacttgaggttcctttaacaaatactaggttataacatttaaagctgatatcacagcttctgttacaagaatattattgtactagtttcctaaggttgttgtataaattaccataaactgggtggcttgaaacagaaatttattctcttatagttctgggggccagaattctgaaatcagtgtgtcagcagggcattctccctctgaaggctcaaggggagaatccttccttgcttctttgagcttctggtggctccaggtgttccttggcttgtggcagcatcacgccaatcttcgtcttgtctttacatggccttctctgcttcctcttctcttttgtctgtcttcttttcttataaaaacacttgtttgacttagggcctatcctgttaatccaagatgatctgatcttggatcctaaatgaattagatttataaacactccttttccaaataaggtcacattcacaggttctacgtggacatatcttttggaatgccaccattcaatctactacaactctagaaaatttattccactttccttatttatttttgttgggtctcatgaactttgatttttttaagctgtgtgaggaaacatttatggcaatttaagttttgtgttgcatcagaatttaaggttgtttcaggaaacacgtgttttatttcacattttaaagtaaagaattatttctctgattacattttagtctttatttctcatgttaaagtaaaaaataggtgacttcagatcagtaagtatatcatggtagtgatattaaagagtatttactaggcttagtataactcaggcaaaacatttcttgcaaattattcaccataatctttgacataggctggattattagttttaaggcatgaattactttctacccaggtcaatggtttttaaccctgttacacattatagtcacctggtgaacctttaaaaatgcatgcccaggacccatttcaaccaatgaatgcaaatatgtggggatgagcttgtgcataaaagtctcctaagttattcttatgtatagtgaggattaaaaactgaccttgactcttattagcagttgccttattcaacaccatttatttattcaatcaagtaatcattatgcacttttaagtgtgtaagtagttgcagtacatataaggacatataagaaatgcaggtttataatttagtagtcatggtgtataatattttgtgtaatgtgccatttatactccagggtggtagagccaaatgcttatagagaccttctctgctggtcactcttaaaaattcaaatcaatttatagaagtaacttgtatcacaaaaaattagccaggcatggtgaagcatgcctgtaatcccagctactcaggaggctgaggcaggagaatcacttgaacccaggaggcagaggttgcagtgagccaagatcgcaccactgcactccagcctgggtgacagagtgagactccatctcaaaaaaaaaaaaagtaacttgtatcattattgctttaactcctctgcactcaggtgcgtgtgtgaacacacacacacattgctggtaataatcagagcaaaataagactcctatggttgactatcttcagattacaccctttacaaggtcaggagccttttaattattttagatcccccttccgcagagtagaaaccaatatatgcttgtaaaaactcacgactggtagtgatccctattagtagaaaaagcttgagcagtaaagttgcctgtgccctggagaagtgctgaggactagaaattcctctagcttccagctatttgggaagacccttgggtgttgagccaacattggcaggtgcgaaagggaatgacactggggctgaggagaggatctggcagccaattagcagcgcttgttagagctcaccccagactgctgtgtgactgctcattcagacattcatagacacccctgtcacaaataagccacccagagctctgtagtcgtacaaagcagcaataggagtggagaagaaccatgtttgtcaggaaggccctgcatgcaagagagcggcagggcagagagcagagtagagcttggaggctatagttgtaataagctttcaggaaaagagaactgagcaccttaattattttatttttttttttgacatggtcttggtctgtcacccaggctggagtgcaatggcacaatcactgctcatttgcagcctgatctcctgggcttaagcaatccttccacctcagcctcctgagtagctgggaccataggcgtgtgcaaccatgctcagctagtttttgcattttttgtagagacggggtttcgccatgttgcccaggctggtctcaaactcatggactcaagcaatccacctgccttggcctcccaaagtgctgggattacaggcatgagccactgcacctgacaagcaatttaatccgaggagtcatggagtcttatacatgtgaagtcttgttgatgaaagataggaagatggagaggagctggaggagaacatgatattaagccaagtatttaaaaactactgatgagctaggaatcaagctgagtgcattcattcatatgttaatcaaatactttttgaacatcttctatgtgtttcaggtgttgacagtgcagaggtgagcacgtgttctccagggtgaaggacactggaggagatttagggttataaaaacaaacagataacaaatgcacatatattcagagtaacatgatagaaatagatggtcaggagataccacctcagtttgggcgatgaggaaggccttgacccaaggaggtgacatgatgtgagctgagatgatgtggaaggtgttggggcttagaaaacaacaccccaaaatgaaggcctcagaagcagcctcagaagcaaaagtttttctctgaccttctcctgccctcctgtttctcagtcccattctctcctgaggctagctatagaaactaggatccctcttccccagggtgggtcatagaaaccagaccccttcttccccaaagccagccataaaatctaaaaatattactctaactttccctccacctttctatgtgaaaactggccacagagaaattatctgacttaccttgtttgactgtaggtcgtaatacccccattccagagagggtcttgcccaacacagagaaggaaggaatgcatgctcaggggggccaagaagaatctagacagacaggccttcctggctttcttcactcagtctattagcattagatcagaccctttttttggtccaataatatttcggcacagctgtccatactttgttgaaacgaagtgtaaaaatggacaatctccccagtatttttgggtcttcatcctgaaggctcccatgtttacatgctaaataaatttgtatgccttttctcttagtaatctgcttgaatgtgaattgatttttcagcaaacctttagagggccaagggcaactttcttcttggccccaacaaaggagaaggacggagatgcatgtaaagcggtccaggcagagggaagagcaactgtaatggccctgaggcaggaatatacttggagtttgcaaagaatcagatgatatccaggctagaatcagagtaagggcatgtctggaaaaagtggaaaaggcagcaggggttaatgataagcacgtggccatggctgggcttcgggaagggtgaggcttcaggtctttgtggtttggtctgaaagcgactgaggttccactgggtgagctgctcagggcacatcctgatgcagacagcctgttggctctgacagcagctctcccatcctcccagctgcaatgactgccgagttggctttgctttgagtattccaatcacacagggcctgcacctctctgcattccctgggggtgattttgatagtttctctgtgtgcacagtgattttgaggcaggagatacatgagcgactgcagcagcataagaagtcagtggtgtcaatgcctgacaactaccatgactgaaaaagttagattcctgaagtgacttcatttatattgccatatcctgacagaatctgaggccactcttggtatatgaacacagtatcatcttatatatatggaaataaaaaagaatgggaggtttttttttttcttaagcaaaaggaaaatattaactcaagacccaaactgttttattcatttgtggactcccacaataccttccttacacagttatttcactgattctagaacacacacttttcctcatttaccatctgtgaaatgataatgcatcttacaatccacagtgcctcacaattgccatcacatggttgtcatagcccatacccacatgcttggtcatagctgttcatgtgttgagtataattggcatttaaactgtgttcaaaatgattacattataatttggcatcagtacttggaaagatacaaatacagtagggagaggataatttgatatttgtgaagcaaataacttcactggagaagagactgcaatgacatatttcctttaaaagcagtaaccatgtgcattgtgggtctgaaggaaggaagatatccacaaatgcatgaggccttattatgctttgttactgcaatatatgaaaaagattacatgttacatgccaaggaactcaacaaaggcaggagtaattgacaaagccctctatatgaaggaaatgttcaatctgtgtgaggctgtgatgggtttatgtgttggacagaatcaccataaggctctgtgtcacagattaattggcagcacttgtttttcttttgtaggaatgcataacataatgatgcatcttataatagatggtatttctaggttccatgaaatagagtggaacaaagtagatgtttttgtcgttagactagggctatgcaaatactagacctcacttatcccatcacgttcaaaatgtctctgcagtttatttacatattaccaaagagctgtccacttgaaaacttatagtcagcattgtgtctcaagccaaggtaaaccaaactaaacattcttatggcaacatggccaggcgctgtggctcacgtctgtaatcccagcactttgggaggccgtggtgggcagatcacgaggtcaggagttcgagaccagcctggccaaaatagtgaaaccccatcttgactaaaaatacagaaaactagctgggtgtggtggcgggtccctgtaatcctagctactcgggaggctgaggcttgaacctgggaggcagaggttgcagtgagccgagatagcgctgctgcacaccagctggggcgacagagctctgtctcaaaaaaaaaaaaaattcttacagaaacttgatactcttggttggtgaactgaattttatcaaaagcatctatggcacacaggcagatgattgtagaatacatggccttaatgaaaaataagctaactgcttaggcgattatttcaaattcagtttaaggaagtcactgtgttttagcgtctgattttgaacatcaggactaaagaccctgaggcttttttcctttaaggtactatcaggtcagtgtgaaaaagctgtttgccaggggagccagttggaaatgaatgaaataatttacattcctgctgtgggcaagttgtcaatcattatgtgtgaagcctgtaccatcatttttctcctatatctacacaaggatgctgtcttaaggatgtagtcaagtgccgtgacaaatagcaggtcaatagctgaggacacgttgcctggtgtgtggtggtagagaaagggcacacctctattccccaaactccaggccggctgcttgatgtaatagcaggttgtaaagtgaaaaagcttctgcatgaaaggatagcctttacatggggtacagagcgcagaaacgttttttggccacacattggtttttctcagccatggatcataatgattatcagtagaatcatttgttttaaatgcagagaagagctgaaatgcttctatgtatcattgcttctggagatttctagaaatgtgtgctaggtagttcaatttaccatgtccaaatggaactcttgatttctccctccaaattttccctaacaaatattcccaatctcaagaaacctcaggccaaaaacatttccaccgatccttaattcctttgatttatctacaatcaatatcacattcatcatctctattttccttgtaaatcctgactcagatattctcaccttcttcaccacaccactttagtacaaggcaccaccatctcttgccccgactactaggtgaatgcctcagtaggttttcaatgacctccatccccattcccacagcagccaaagtgagcctttcaagcataaaccaaaccatatctctctcctgtttaacacccctctgatgctcatgctcacatttagattactatgcaacccctctccacagctcacaatacctgatcctgggccaccactgtgacatcttttctatcagccttttccctggctcatgctactacagccacactggcttccttgctggtcctcaaacaggcacggtcctgccgcaggggatctgcacttgccgctccctcagcctggagtgctgatctctgcatggcttcttcccacacttggttcagatctctgcctaaatgaaacctccttaaagaagtctttcctgatcaccctcctgaagatctggtcactgtctatcctcttaccctgctctatgtttccttatagtatgtgccactagctgatatcatattacagacttatctgttacctgcttattgtctttgtccagctctagaatgtaagttccataagagcaggagctctgttggttttgtttccaatgcatttctagagactagaacagtgcttggcatatagtaggtgttcagtaaatattttcattcaatataaatactacatatacttcttcatatgtcgtcttcccagttggacactttctaggcatactgggccctcacaaagatatatagagtgtggactacctttcaactgaagcattttaccggacatgccaactgatggcagcacccagggatggcaatgagatggtgtgtgcatcacccaagtggccctccacagtcaagtaggtcgctgaagtctgtctctgatgactttgcctcccacgtcttcctctgtgtctttctttcccattcctcccctggcagcaattcattcagtgggtatttttaagcacctgctttgtaaagggcattgtgtgaacatacagctgagccctccgaagtcaggtcttcaaggagtttggtgtctggtggagaggcgcgatgaacccacacaaatacaagggctggtaaaaggtgaagtgtcttgccccagtggaataaggaactagaaactgaaattggctcatctgactctgagtccagcctctcatccactctgctgccttgcagcccacccaagcctgccttccctctggcgctcctctgcagtttgtttgtttgtttgtttgtttatttatttattattatactttaagttttagggtatatgtgcacaatgcgcaggttagttacatatgtatacatgtgccatgctggtgcgctgcacccactaactcgtcctctgcagttttaatctttgttctaaatcctccttttccccttctctatattcaaagcaccaaatcctgcccttctaggtgaagttatacatcagctgatgatcagatcagactagttcacagtaagtgagaatgactcatagatttagttctctcaggtggcgtttgtattgtagtttgtctctgctgcagccagtcacaaggagatacatgtgtgggagtatctgtttctctatttttggggggactgcgggaaaaaggatgccacctggggtctgcttatttactgtaagtctttctaccttaccctgcctcttgggcttccataatgaagtaggtctggccatgggtctttctccttccttagtacaatttctaaagggaaggcaatattccatttttggcatttgggaggtggtgaaacaggcaccctctctgttctctctcactctttctctctctctatgtgcgtgtgcgtgtgtgtgtgtgtgtgtgtgtatagtggtactacagggtcatttataccagcacgcctcataagttgcacccctgttcgtcttgtgcaccatgtgccctccagtggctgccacgaagaagaaatggaacttcctaagtcagccatcctgacagacactgttggaaactttctctgcaaggctgagaacatgagggaaagactgcggatgttcattctgttgttaaacgtatctctgttgcaagaccagcctagtgtaccgcctttcatgacacaatacatctgtgaatataaaataacaggaactggtggcttttctcatcaaaatccaaccagttctcttcagacacttcttaacctgtaaaatgggaatggcaacagtgtgcatctcatagggttcaggtgaggggaaatatatcaggatatatgatgtatatatgacatatatgtcagacttagaacactctcacacaaaagtgtctttaggtcaatcaacaggtatttatttgccacctccggtgtgctagaaactgttctaggagctggggatacaggagtcaacaaaataatctatgccctgatggggctgattgtggttaataatcatgatagcaaaggcatagccaggatccaaatccccgcagtctagctccgagtccccagtctcctccatgactccatagcacctcttgttcactgagcaagagaatgcgaataatacacttgagatgacgttgtgagttgagagcctggacctcagggataaagacctgtacttggcagccatctactttgagtctgctagctgaaacctgtccaagaacataacactggggaaaggaggtttgagaaaaaattcttgagcaagattgacaattaacgaaggggaagataaaggaagagttactaaaacaaattcccattattgttactactattattccctgtgctcatctagaggagtcaagtaacctaaggaatcaaattcaatgaaaaaatattggttgcacacccactctgagcgaagagtggatgtgcaacaaatatttgagcaaggcacgaaaatgatttttcattagacagatactttgcaatttaattttctaaaatagctgagtttgatggtcaatgagttcaataaacaattttccagctttttatatatctagcaattccatgatcacacagtgtgtttatcatctatcattctccaattactgaatattggttggggttcctgtcccccagttttccatacatttaggcctccttgcatggtaccctatccaggtcatttttttccccccggtgagcccccattgatcatcttagattttctgagatggttttgatttcacatattttgagtgggggcttacaaacaataataagatcatccataattctaaaatctctcttcttttctctaattaaaacctttgtgggccaggcacattgactcatgcctgtaatcccagcactttgggatgcctacataggaggatcacttgagcccaggagttcacaacaagcctaggtaacataaggaaacaccgtctctacaaataataaaaataaattagtcaggtgtggtggtgtgcgcctagtcccagctacttgggaggctgagaagggagcactgcctgagcctggaaggttgaggatgcagtgaaacttgattgcaccactgcactctagcctgggtgacaagtgagaccctgtctcgaaacaacaacaacaaaacaaaacaaaacaaaataaaacaaaaaaacccataaaacaccaaaataaaacaacccccccaaaatctctggggtgcactgattgcagtaatggtcccatttcttcacccttccctactctcaagctatttaccgtgtgattttgcagttgctcctattgagaggtgaactatatcctcccctcccaagctgattttgagttttccatatagcttcctttggccaagtgttggcagatgtgatgtaagtagaggtgtaaaaaagcgcttgctcatttttgtttgtttgtttctttctttgttatgaagacatgtctgcgatagcatactagagagtggggcacagggagtcccagctgtttcagctgagaccaccccaggtcagtcaactctcatatgccagaagactagagccaactgccagatgtgagggagccagatgagatcagaagaaatttgcagccaagcccagcctaaatcgctgacccacaaactgtaagctcagctaaacaaatgtctatcgctttaagccacttcattttcagacagcttgttccatagcattgttgaggcaatggataactgataatgcttcccataaatcttaggaacttggaagctgcccctccatttgccctcctttaagcaaaaaattgaatgctatttgcaaagcattgtataaaatgctttattagattatcttattgaatcctgacaacaatatctagcagacagatataatgctattatccaaatttcagaggcaaggaaattgaagcttagagaagtttaagtgacttgaccaaagtgcttttagaaaagcagagattctacaaccagtcttctaaatcttggaagactgcttttagccacggctgcctgccatttactctttggattctccattctacctgttctgctgcctacttctaccacctaattaggagaagaccttgtgttcccatttgggatatagatacccactttcatactgggtttacccctaatatttctctccataccactcatgtagatggttgtcttccgcattaatctggaaattttttgagggtaaagactaaaatacttatatttttatccccacaactctatgcagtatttttttaaaaaagatcatagtcatgttttaaggtagctattccataaaacatataaaaaggtaaaaaatactctcctagagaatatatgcatatttaaaaggacactgttattcaaattaatctaatttgtggaatacacagtagagggttttccccattttgttaaatagttttagttatatgttatttgaatgtagtgtttgcctgaatatctacaaaaataaaactctcttgactcatttatagattaattccagaagcagggattaatacaaaactggcagtgaataatttctgttttgcagttagtttctgcatttaagaaattgctttagggttcagtaacttgccctggacttcaggtatgctgccaccagatggcagcagggtgccaggcataaggcttgtaagcaaagaatttgtgtgctttctgaggctcaaggtaatagctctttccttaagttcaaaaagattttcagaccactgatttccaatttagcataatacatttctttacaaaaataggtaaactaaaactctaagccaccctaagacatctttagaacagatataaatcccaagctataaaatcacctaactcattattacttctcttctctagcatctaattatttctgtaatggcttatacaccatgatggcttatacgaatcttatacacctacctcagtgatagtgttaaccattataatttactttgaatctttatgatcaatctctgccatggcaccgtgtatgttagttttcaaaattctcaatagtttttctccaggtaaaaaaaatctatctggctttcctttcatctgtcttaagagagcagaggtttatcttttcagtattatctgagatcttctcttaagaccaaaagtatttctccactacagtggcatgaacagtgtttatttgcatttcgtgtatgtatttgtgaatatggagtacttttgcttttgtattttctatactatataataatctactagaatatttcccctctcaaagctcttggaagcacagaggcagtttaccatactttaacagaaatatagctggattaaaattttttttttttagcaacaggctctgccctaaatatctcaagaaaatactttaaagaacaaaaatcttcatgccaaattagcaagatacaggaaaaaaggtaagtgggcaaaatacagggaaaaaaagctaattcaccctgacagttgttacacaaagctgagagagtctttccctctcacatttacaaagtccaggagcggaaagactttcagcaggagtaagccatgagggtttggacaaggctggtaggggaaaatgttatctcctgggcatactgggaagctgagagtccagggcaggtgaatggggttggagatgggaatgagggaggacagcatctgagcagtaaatcctggaactagagttagcatatcaagcagggctatctatgcacccaaggtaagttctggctgggagaagcagatggcaactaagctgtgaaaataggctccaagggaccagctcccagcgtaactctgggggagggatctggggaagtacaaaaaacatagagaggcaaaagacaaataaaataggaggagaagagaaagggatggatcatagaaagctcttatttgattttgagtctcacaggaaacccatgaagccagcagggcaggtattttttatcctctatttacaaatgagaaactgagtcccagagggggtaagtgactttttttaaggtcaacataccgaggggcggatataagattcaaagtcaagtgacctgattccaagctaaagatgaaagaagagagggcacatttgaaaccctgacacacacactgtatgtcctactctttgctttataaacagtaagtaaaattttcaaataatggaagcttagtcttttaagggtcaaacggaagcagctttagccactgttgaaaagcatttctgaaatgtattatatttgcccttgcctcctttgaaaactgactgtaatctactctcttcttgatacatgggttataattacaaaaatttactatatttatgaacttctaattcagtagataccctcaggttctatggaggcacatgtgttttttaaaaaattaattttttttgctgccccacctaatacattcatggctagaaatagctgtgtagcagaactggctgagtcagctccttcttccctcacagccagctcttccttcttaagtgtgtctgctgctggtccctatctactgcttctgatcaggtcattccgcttattaaaatcctttagtgactccctctaaccactggttgcagtagtttgcaaaacaggctgcacatgaaaatcacttgaggagcttttaagacctcctgatacccaggtgccaacacgaaagatttcaattcaattgttttagatatggggccctcacctacagggattaacataagtagcatgaactcttgcttctggccaagatggaataacgggggctagatttatctttccaatggacacaactaaaagtccagatgaatatattaaacaatggttttcaaggcaacgggcatgaggcattgaaggacagtgatccctgagagatggaaaacaaacaaaatgagttgcatttgcctgcaattgcccctgagagaatttctaggccatgcagcagaaaggaagaattcagaaggagtctgcaagactccttaaatagaaaagatgaagcagagaatccaggtagactagcgtggctagagtttgccaggcagagtattagagagcagggagttctgatcagtacatgcatgtgaggaaatggtataaaatcaaatgaaaaaccagctgaaaagatgagtaggaatagtctttaaagttcaaactggactggtaaaactgagatttgaaaactattcaaattgggaagccctgaaattcaaagagcattggtcaagtactcagaagggtattgccctcgtggtggggaagtattgtcaatagactaaacaatactctgccttgcctaaccttaaaagcaagacctgaaagatcaaagactattcaaagaattttcctgtatcccagagcaatacccaaaaatatctgtaggaataaaaaaaaaatccagcatccaacaaggtaaaattcataatgtctggcgtgtaataaaaattaccagacatgcaaaaaaacagcaaggagaaaaatcaataaaacccaaacctaaactgacacaggtgttacaattagaagacaaagatattaaaccagtaactgtaactgtattccatatgttccacaagttggaggaaacagcatgtttaatagagacagaaaatataagaaagacccaagtctggccgggtgcggtggctcatgcctgtaatcccagcactttgggaggccgaggcaggcggatcacaaggtcaggagatggagaccatcctggctaacacgctgaaaccccgtctctactaaaaatacaaaaaattagctgagtaaggtggtgggcacctgtagtcccagctacttggaaggctgaggcagaagaatggtgtgaacccaggaggtggagcttgcagtgagcagagattgcagagattgtgccactgcactccagcctgggcaacagagcgagactctgtcttaaaaaaaaagaaaaaaaaaagaaaaagaaagacccaagtctaacttgtgaagatgaaaactataatgtccgagataaaaaatacactgcatagtaacagtgacagattagctattctaagaagaaaagatgagtgaacttaaagacatagcaatagaaacaatccaaatgtgtcacagagagaaaaaagactgaaaaaaaatgaataggacattggtgaactgtagtacaactttaaatgacctaatactgatgtatttggggtttccaaatgagaggagaaataaggtgagtaatagaaaatattctgaggccagatatggtggcttacaactgtaatcccagcactttgggaggccaaggcaggtggatcacttgaggtcaggagttcaagaccagcctggccaacatggtgaaaccctatctccactaaaaatacaaaaattagccagatgtggtgtcgcatgcctgcagtcccagctacttgagaggctgaggcaggagaatcgcttgaacctgggaggcggaggttgcagtgagctgagattgtgccactgcactccagcctggatgagagaataagactctgtctcagaaaaacaaaaaaatttaagagataatgactaaaaaatttccaaagttgatgacaatgataagtctcatatttaagaagctcaaaaaacttcgcacatagaaaacatgcaaaaaatgataccaatgtgtgtaataatcaaattgctgtaaaccagtgaaaaagacaacaccttcagtgcagccagggggaaaaaaactgacccattatgtatagaggaacaacaaaatggcggcaggtttcttgttagaaataaagcagaagagaggctggtggagcaatatctttaaagtactgttcgttagaattctatacccagcaaaactatgtttcatgaatgaaggcaaaatgaagtatttttcagacatacaaaagctgtgaaaatttatcactagcagcctcacactatagaataatgtcaaagacagtccttcaggtagaaggaaaatgacaccagatggaactaagggtctacataaaggaatgaagagcttggttggcttcaagggtgtgtgacctgtatggttacacaaggtcctgcagatagaagggccttgtgctagctttaatgttttgatgttactggctaaaaatttttaataatttttgaacaaggggccctatattttcattttgcactggtagctggtcctgatgaagaatacttagtagtccatagaggtggaggcagaggctggaatgccgagcttggctctgaagatccaggccatatgttcaggcatggaatagggaagagatggaggtggcttcttcagaggaaatttggaatgttttaattttaatcacgagaagggtgaatgaacagatgtccactaaaataaaaattttaaggtagcaatttctgggtaattagaacacaattttcctttctgcacagagatagatcataaatggctataattagagagtttcagttttttctgaagttcatttgttgcggagtgttcaaaactgtctcttcaggccaaaatgccttgtttattgtgtgtgtgttttactatttctgatatcaatgctttaataatgcctgttctgtaatattggcccagaggtactgcaagagtgtaaattcactttacatgaaaaagaaaagctatattacttccaatgacattttagtgattaaatgcattttatttgtagtataattctatcccagtttaggtcaaagctccgaagttgagagtagtataataagtgtggacatgcaaaagatgctgaaaggtagtagaaataataatgtcagatctagcccatcaccaccctccagaacatatatgaaaggattagaaatcaatgttaagtgtgtatttatttgggagactgtccatcctaaatgaggacaaatgtcagggtgcttttcccaaaacttgggctggctgagggaagcttcaagagaatccctggaacagcttgaaatctggatgcagggggtggagttggtagagtccagaagctttacctgatatatgcctggaaaagtctaaagctcagaggtggtatctagctgtcctgaaggcttgtggggagccagctgtactgtatataggtataaatgcaatgcttaaatccacagataatttataaagttcactctacacttgaatactcacatccagtcatttagttgaagccttcggctttgattaaagttgttaatatttgaagtgctgactgatgtaacctccctggtatggaaatatgaatatttctcatttattatgtcccgtggtgaaagcataaccttttacttaaaataattggtttgaaaatggaattagaatattcatcctccccattcctcccctgcaatttgtgaatttagtaattattcttcttggttatgagcataagttaccatttacctttattcaatatgtacacacgcacacacacacacacacccacacactctcacagaatgcaaaaaaaaaattaggaaataaagttatcgcaactttagcaatgagagcggggtagacagaagtgtgagtttataatgctgatcatgaaataaaaacttcaaagcaagcctaaatctgatactcataggatgatagctctactgcatttaaagcaaataaagttacatttctcaagaattaatgcaaaattagaaagtttcctttgaaaatctcttagcacatctccaagtggttagctttcctgggaaagctggaaattaaatcaacaacattgaaagaaaaaaaacctcacagtcctaaattaaacagtcatgtaaatatagtttccaaagctattaggcaagaagcaaatgattttctaatcaatttactgttgcaaaaataatgccagattattttcatggggcatgtgaaataatttacatgggacacacgtggatattgctaccttagcaatcttatctagttctacccaaaggtatttaaaaaacaaccactgacgctgaagttatttgtaatcatatcagcagcctatctcctcatcctccattctcttcccctccaccagctgacttttgtatcaaaggcaggctacccttgcacttctcttttcacttaacatagaacaacagttactggagcaatctggttcccttaaaactagcgactcattacaatggttcaggatgtgaacttccctaaaaggctttgctctaaatcaaggtgactgtacattcccttttaggctagaaaacaacaaactatgcattcttagtataggattattcagcccatatattatatgagactacctcatatttgggtacctctctcattagttgggataaacaagtcttgaatttgagataattcaaaatctttgtaagccaaaggcatgcacacattttgcctttttctcattttaaaacccagtaacccaaaaccatcacatgaactacccaattctattgggcatacaaattttgttttctgatttccaagtctgaaggttcaggtcaatatttgtccgtaattaacatggacataattaatctgctgagttaaatgacatacaaatcctcaccaccaagagtgtgaacttgcccataaagttgtcacacagaaaattgaattcaatcagcttactttaaggaaaatatactgagttagtggtagacacagatggcatgcttcagaggattttggccttaaggtctaagagacagtgactatgttttcaaattttgacacaatgcttgtgacaggcacttctccctgtattgaagccagaaaactgttaagagccaacatgggtggaaaagaccagttttctttttttctttttctttttttttttttttttttgagacagagtcttgctcagtcacccaggctggagtgcagtggcgcgatctctgctcactgcaagctctgcctcctgggttcatgccattctcctgcctcagcctcccgagtagctgggactacaggtgcccgccaccacgcccggctaatttttttttttttgtatttttcatagaggcagggtttcaccatgttagccaggatggtctgatctcctgatgttgtgatccgcccgcctcgacctcccaaagtgctgggattaccggcgtgaaccaccacgcctgactagaaaagactaattttctgtctcaagtcaaggctgattggcctcatgggtggtggtggatcagtccctaagccccggcagtaaagccaggggccgtgatccccatagtcactgcagctgtctacaaggtctggctgcagtcactaaacaaggatctctaggccacaggtacccccggcactggggaaagtgagtgcccaagcttacatcttaaacactagttcaggcctttggattttgagagacatagagcctcacattgtaagtgatccttacttcagtgaaaacatataatagagtcctattgaaatccattctttacaatgggagattactgctaatgctagctaggtgagtgattcatgtgctacctattgtaagtattaattcttcattaggtagcagtgtgattcagaaaatgttacatagggatatttttcaagctattccattaactaattaactgggatgcaacttaagttggaagattgtttggttgatgtatggaaggtacccctttaaaaaatatctatgagtagccatgtgatgagtgtcaagttcttgacagagaattgaaatcttagcctgctgcgaccaaaaagcaatactgtttcagttagttccgttgccacacagactgaatgaaattaaccaaaggctttatgttagacaatgagtctcttctgaaataatgatagcttttgtgagggcataagaagcagaaagttaagaaagagttacttatggccatacaatcacattaatttgtctatttaatgtgacttttagattcaagaacaatttctatacgatgttctagaaaagacattattttttcagaaagacttttaaaagcaaggaattaattagttactaataataaccatcatttaaaataagcaatggcatgtaatgtgtagaaccgggacttttggcgagaaagtgacataaagagtagaacagagcacttttgaaccagcagaaacttatttgctttatctcttagttcataaatgccattttcctcaatcatttactataaaactaaaactattctttaaaaacctaagtgatttctcattgttactgttaaaaagaaatgtgtgctatgccaaatacaattcaaatgaatgaccattttatgttacattttcatcttattccttcatttatgctagaaaataacaaaagtaaaaatgcaatgagaaaagtatcaaagtcatgtatgcagattcagttgatctctttgggcttgactatttggcaacatatgttggccagtttttataggaaatctatgctaagtgtatgaataaaacagagacaacgtaagattagacactagcttcagaaaataaaattttgataatacagcagcctatttagtaagaataaaagcagtctcttggagtgtgggatttgtatatgtgattaagaaatagagacaaggggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaagaaatagagacaaggaaacatgatagagatagaaaactaaaaaaatgataatttaaatctttaacagtgaatatgagcaaagatcagaataggaacctatttattatcatatctatatcctataactgaaaaaatttcctaaaaaggagaacacaaaaatgcttggaagattttcttggataatgcaaaataccctgggagttctctctttacctcttagttcccccacatttaaacttcaaaagacaatgactctggagcttgagagagatcgatatttaaaacagaaggcatatctataaatccccattggatgtccaaacacttataaaaaaagaaaattaaatttcatttatcaagggttgaatagttaaggtgtcactaagagaccaacttacattaataagttcaacctcccagatttttttcaacaggtccatcgaagtgtagccattaattagaaaggctttggtgtagtcgcccagttcaatggaatccagccactcagctacagaggtgggatggtagccatcatgcccaatgggtctcatctgtaataaagaaaattacattaggattaaactgtatactttgtgtcccaacaacagaatgcagatttccccttgaaaatttatttgacatgaagaacagatctttctggagacggaaacaaggaaaaagaaaacactttctgatgtgttttcacaattctaaaacattaataattttcacgctgaataggttttcaaaatatacacagaaatttccaatttagctgctagattaactctatatttggaagagctaaacatgtcaaacttctgtcatagacattattggcattctggtgggtggaattaaaaatgatgtcagttgaatggcattaaattcgatgcgaaagtcaccaggaagtgcactttcaacatgtagatgataattctcatatgcacagcaccaaagcatgtgaaaatactgcatgacttaagcattcaaagggaatttgtgcttatgcaagacatgtattggaggtagtgcaaacacgctggagaaacatactgctgcggtgaaccagtaaaggagaggcctttgggtattttaagaccatgtgttctgcatcgactctacagtatgttagacatgaatagagaacttgctggcagacaggcatctattttttgtcagctatatacagatttttaaaaaataggagaacaaagaaatgtgacagcaacataatgtttctgagtttaaattggagtgtgaaagtaatttaagcaagaggaacttctgggtttaaaattttgtatggattattctggtcctttagcttttatttgaaattgtagctgaatctgtggttcttggttttcgaagtgactcacttctaaaacttgggctgctttgcatgccacgccgtatatctaatacttcagtttttcaggagagctggcacctcatcaacctgatgggggccttcggtaaaattcacgatggaaacagcaaggctgggcaaaacacaacatagattttcctctttctttgattcaaagagataaatattaatggaaatttatatgattctgatttgcgagcagagaaaagattagtctgggaatcagggattcagattttaatcttaaacatggtaagctttctatcactatgcatggttctcatttttgagattctccctactccttcattttaaagttactttttctcttttccagttgttccgctccccattctagtttccatttcaaagtttaaatgttctctgttttattttattttttttgaaatggagtcttgctctattgcccaggctggagtgcagtggtgtgatctcagctcactgcaacctccacctcctgggttcaagcaattctcattcctcagcctcccgagtagctggaactacaggtgagtgtcaccaagcctggctaatttttgtatgtgtctctactaagagacagagtttcaccatgttggccaggctggtctcaaactcctgacctcaagtgattcacctgccttggcttcctcccaaagtgctgggattacaggcatgagccactgctcctggcctaaatgttctctattttaaagttagagtacaatttattatttacattagagtctgaacttggtcagacttttgtacttcacttttacattgactgacccattttagctactcattaaatatttgttcatgtaacacttaactctgtgtttattatgtggtagctacaaatgtaaatgacaactcagcatttgcagaatgaaagtcagtggcattcacaaatccctggatgttatgtatgtataagatcagaggctaggacccaaaagggaggctcatagatattcggtagcttcatattctatagagaattacaaaaatattggggctgggtacattctccaggcctcgttaaaaggtggttgaactaactctgttaacctaaataatcactctggccccaggaatcttcctgactgccccagtgacatgaaataagaaagaaagggaagaaagtgagaaacactaaggttgaagttaactgcttagtagggaggtcttgccgttggcccatccataaagctgaccactccagcagcagatactcgggaaaagcttagggagtcttgatgactggatttgggtcaaagtcagttgtctcataccagtgaactgtgcaatggggttaccacaggttacccccaagcacttacacaacactcttttgaggaagcaattagtggccatctgacacacagagggtgttgatggtcggtggtggccaaagaatcagggaacccatgacaggactgcaaagaaaatctaggtaagtacaaagatgtttgcttgtccctccaatccccctttcttgtcccaatgccagaaaatttagaatcagaagagagaagtgccagtcccttaggggaagtctaaacttgggggggggggaggtggtgaggaaaataaaactggaggtttcaaataaattggaactgagccttcaacattttacatggttggaaagttattggaaatgtctgagatgatatttataaatagtaaagggagggtcagttgagcttggttgaatgattggaaaataaaaaaataaaataaaacagcaaccatcatatcaggattgcacggaatgcaggctgttcagtggtctgattactcctgtaaggcaagttctcctagaccaatcttaaagaggtgagagggagggaaatatttggtgggaggatgaaagacaagggcagggtagagagcacaactgaagagaccttggaaatgggtatgctgaggtgtacagggcagtatcatccgcccactcattcaataaatatttaatcaatgcctattctgatgaatgttgtggaaatggtagagaacaaaacagtcatagtctctccctcatggagattataactcttaattaaaatatgcaaacagatgaccaataaattatgaaggttctgcatacctgaagagaggaaaccattagagccaaatgcagttacaaaattaacttgacacatatttaatgatatgcagaatagttactgtgctgcacaataatttcttccaaagcaatgatcccatctgttcctttatttctgtccctactgccattaccctgtttaggttcttgttagtgcttacaaaaactaacacaatagccttctacatggtctcccacctttgatccagcttgtatcttgctactacattagtcttcctaaaagtcagacccttaagtgtacctttgtataaaagcctgtagtggctccttctcgaaaaaagtccaaatgtcctattccagcattcaaggccgattgagattagcctaatctcccactcctctgctattgtgtacccaataaatgtaactagacacgtgtatgtctaaacagtacattaaatcgctaggcattccctgaaaatgacctgtatatgacacagtcaatatctttgctaatataacttcccatgcttggaatgcttttgcccctgcttctggagtgatttcttcaggactggcttctcttcttgagctctgagatgcaaatttctaaccatttgtaggacatctcacataaatgtcctataggtgtcaccaacataagtcaaaaacaaatttaactcctttagttcaaaaacaggctctcttcctctttttttccatttcagttaagggcaactattactccactgcccaagcagaagcttgggagttatcttactttcctctttctgtttactatcatatctaattaggccaacatggtctatcaatttgatttctaagatgactctcaattcatttctcttcttccaaaatggactttggaatatgacattcccagcagtgctacgtatttgttgggtgatctttggcaagttactctttcagcctgtttcctcttttttagaataagcataataatacctattccaagtgttgttgtaaagattatatgaaatagggaataaaaattgcctagcacagtgatttgaatataatagctattcaattataactcttagttctcttttctccccattgccctaaattagacccatgcttattttgaaattgcataatattctgccattggctgctagtcttttcagcttccaatcaaagctctcctctctcatcccttcctatttcctctatttccttccttctttatcttgttttagaaatggtttgcatctgctaacatctttacccctctccccttcagccgacagttattttttagaaacatatctaacgaggtcactcaagtcgattgaactgtttattccaattcttcgttctcttactgtattagaattatgcccctgtgccctttgccaagggatcaacattatgtctcagtgtggctggagttacttcccagtctcatcaatgctggccaatagaatgcgtgaagtgtcagtgtggtggttagagacgaggtctctgtgctcctgtgttctactaatctttcagtgttcatatgctctctcataagaatagcaagtgctgagaagttgcataactcctggttctaggagaaagatgaagactcgtggagcaaacctaaatttaacccaaagcttggaatctaccctagctcgatggggctcaggaaagtccagatgaagttagctgaagcacagcagacccgtgagtaagaaaaaaatattttttgttgttgttgctgtgaactactgaaattttgattacagggaaaaactgaatagtcactccttgtttaaaaacccttggtgtttatccattatgcctgtggaatataaatcagaccttttagtttatgaatctattggcaaatgcatcttcatgagactgagaaagattagggatgctgaataagcaaacatcagtatccttcccaagctacctcactgtcatgcagaaactctgcatgccacatcttttttttttttttttttttttaagacagagtctcactctgtcacccgggcacccaggctggaatgcagtggtgcaatcttggctcactgcagcctccgcctcctaggttcaagcaatcctcccacctcggcttccctagtagctgggaccacaggtgtgcaccactacacccggctaattttcttttgtatttttagttgagaccagggtttcaccgtgttgcccaggctggtctcaaactcctgagctcaagcgatctgcctgcctcaacctcccaaagtgttgggattacaggcacaagccactgcccctgccctatatgctgcctctttattaaccctaaactaagtaattctttattgtatgagtttgatttttggggcataatccactgtacatgtaatatacctccacatcttcgctcatgccattccctctgctaggaatacagtttctactttttctcctaatgaaattctatctatccttttttttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaattctatctatccttaaaaggtcctgtttaaacgttacctcctgtgtgaatctttctctaatgttaccattattccaccgaaaaatcatatcttctgctatatttctgtagtattttccatagagttctattatagtattattaaagtctgctttcaataatagagaagtgagtatctgtcttcttcattggactgcctaccccttggtgaagaaatgaggtgttaatcatttttgaagtccctaaatcgtccagcagagcatctcacatatggcaagcatatgctaaatgtttgttaaattaagtgacttaatgaatacatgaagacaaaatgacaaattcatttcagtggcttggtatccatttgtgggagagatttgtattttgtactccatgttatgaaaactaaggttatctttttctgcctaacaataacattcataactatttaaaacctccatatatcaagaaccagttccagataggatattgtgttacagaatgcaatggactttgtttccatagcacagaagacttgattctattagccatgtagccatgggcaagtcacttcatctctctaagcttcagtggtgtcagctataaaatgaaggtattggaccaaggatctcaaagctgctttgtaattcctaaattttgcaattccatgactcgtaaattaattttaaattagtaacctatttgtttacccaggaaagaaaaaataagcccaaagacaaaactaaaattcatatatatatatatatatgataggacgtgtagactaaaggtcagatggcattcacatttctttcatgtatcttcagcagtacccacagggagcactgtgactgcattctcaaattagcaatgatgaaactttttttccagcgggaacatctggcaagacagggctaggaagtgacagctccatcggcctgccaggccagcagtgctgctaagcatgaacggaagtcaggctcactctataatctgagaggcagagtggtgagcaggcagcaggcattcattacagaggctcgcaacaaggcaatttgattcaattagttgaattccaaagtctggaaaaacctaagctgagacagaaattcgagatagcagtgaagctttagtcttgggaaaattgagatatattaacatattttttttttgccaaatgccttccttgttcttgttccacccaaatgactttcctccaggagttttttagagcatacttggcctcagagagagtatgctgttaacatcacaggtggtacagcaggcagagaaaccacaggacagtactctgtggagttctgggtttgagggggtcagctacggggcagctgaacaacccatgctctgagactgcttgatcgacttcaaccagagtaactcttattttatgcgttttatacaagtaagaggaagaaaggttttctcggctttaaaaagaaatgtttgaaaaccacgaatctagaagacttttgtaagattacatgaccactatgattttattttctcttaactttttagctttatttgaaatattatggatctgttatatatatgtggttatatatatatatacacacatatacatatatacacatcacacacacacacacacacacacacacacacacacacacacacacacatatatatagagagagagagcctgtcattccatcattctttctctttgcctgaagccagcattttctgtgcagataaggataatatcttatgagatgacggagccacaggatggaaggtatagcaggaggaaggcaataaaaacaggtaaaaaaaataaaaagagagagaaaggtgatatacattataatagctttgggattaaatgagaaaagtagttcttgatgggacaacttattaacctagaattatgatattggcatggtatttagaacaagaggataaggaaccctgaaaagccaataatggattagacaggcatttttatgtccaaaagtgttagaaaattgagaaaaagactacttgttgttcccttaaacttgtcctctcttcttccacataatggggttaaattgggttcatgcctgccggactagagacaagatacatcagctttttttctggttgctgctgtgaaaatatggttgagcctgtggaatgctaatgaaagtgttgcatgtaactttcaggtcacctctagctaaaagaagttcctcgacctagaattcctcttttttcttcatcttcctataagctggaacatcagtgactgcagttcagctttgactacacaggcaaaacaataccctggagtctgggaaatgcttctcagacctcaacgtgcttaggaatcatgcagagaatcttattagcagacgattctaattccgttatttggagggaggattggagattctgcatttctaaccagcttcctggtgatgctaatgctgtcagcccatgaaccacactttgagtagtagtgctttggaggatgacagaacaacaaatagaaggtcctcggtccttccacaattgcatagagcaaagccaccttgtaaacctgcactgctcatttcaagactattatatgagagaaattaatattcgattctttaaaccactatattatgaatgtctctatttcagtatcatagcctttccttgaatacaaacataactaaaaataaggcagtttcatgtagaacatttaaatgaagcctgtacttccatttgacattacattgtattatctcttgttttgtggggccgtaagttttcacatctgttatcgttaaagaagcttcatttcctttaactgtgtttgttggcatttctctgtcaatcacagcatcatccctttgtaacaactatgcaagggataagaggagaaaaatgcagggaaaccccaagtttctagcttggatatctgggcaaatggtggtgttaccaggtaaaagagaaaagaaaatagactgggatgacatgaataattttgagacatgagaaatttaagatgctatgctgtggaatggcactttaaatttggagaagtctggggagacacgcggccttgggcatcatcaaagtacaggtaagagtgttggcaactccacttattagctatctgacctcgagcaaatcactcatacttcctaagcatccattttctgattagtaatgtgaaagattaaaagaatatctatcgctgagcgttgccatatgtattcaatgaaactacacaaggagaatttagcacaatacttggcacacagaagcactcaataaatctttgttattttttttctgacagctgaaatcatgcacaggtaggactgcagaggtgactttgtagtgtgagaagagaagtggcctgagaatgaaccaacactttcaatgcataaggaacagataaaaataatactcaggagaccaaagaaggaatggtcaggacaagaaaagaaatgggggaaataagagtgtcaaggagagtgtggtcagcagtgaggggatgctgcagagacgtctaataaaatgatgaaggagaagggtttgtgggatcacaaataggtcatcggaaataggtcaccagacaccttattgagaagagcacagaagctgagctgccctaggttggggagtttgtatgggaagaaaagggggagatgagattttagaaagcacagaggaaaacacatggaaaggggtaaagaaatgaggactcagggttgagaagggtcagagtcataaaacagttaagttccagggtgcagtggagattgcaggggagggcttgccttttgctttgacactttgccctcctttcttgaaattacggatctgacaaggatggttggagctaacttcagggtgaatactctgtgttaaaacagtgcgagtgtttggaagctacatggtttagacttggtgagagctggatgcttgtacgtgaagtacctgtgaccttctggtgaaggtcctcacgtgggcaagagctgtcgcctgtgttgtcttcactcctcagatacaaacacagcaacctatcatttacatagacccaccagtgccgatatccctgatgtgccaggctcagctacttaaacttgcctaggaagctgccgtggaccgtggcttctcttttcccacctggatgtactttgtacactcagatttcctgcctgatatggcttttgtaatacagatagctgatatcgtcaggtacttccctctattctggctccttgttctagactcttctgctctgtcctgctgctacccaagtcttggactaacagcagtcctgaaaataaacgaggacaagcagtgctagcagacagtgtgctgccaagtccaaatgcaggtctatcaagtagtgtgaggatcaaatctacaggctgtgagacctgggcttagacatcactgtgctgtttcatcagtggctcttaaaaggctgattgaacataaaagagaaaggctgatcttctgaccacgaggccccagaaaaaagtctacctatcaccatctgagtgctatctacggcagtgcaactttgctgggagggacgtctccaaaatgctgagcactgttaatgataagaacatcacttaacaatgatgtgggactttaaagagcctcaagtgatttcacgcatgtcacctcagttgtaaagtgttttaggtgatctttaggaagacaccctttaaggagtctgagagcctgagtatcccatataattatattccttctgtgggaatggaaaggattaatatactgtgactgttgttggaaagcaaggagtgataaactctctgtgttgtgcatctgtagcaagggaggtatacatgtacaaatacgtctgctacttgcagctcctttgtttacaattagactctgttatggatacaatttctataaaagaataaagagaaacataaaccctcagaagtaagaaaactgtgtctgatgtcactacgaactcacagctacagaaagtggtaacccctctattatttttcccaccactgactgagccttactgatttggggttccttgagtgttcagatattgaagactcccagctgtaggcataaggcagaagcagtgaagaagtagtatctggatattacttgatactacatttttgggaaataaagggaaaggaaagtgctttggactagacactgtctctcaatgttctaggttttctatttcgtgaaaaagagaaatgaattaaggtctattccagagagggcctgaggtatccctaattttgaaaagtcttagatcatggagtaaaatagaagtgaagcaatggacagcaatgaaggactagatttaaaaatgttttcaagacacataggggatcagcttccaacagcacagaatagcctagaagcactagactggccctgtctctagtcatcagggataggggcacgccctctggacaaaggcactgggaagactacaagttaaaggagttaagttgccaatgcagccaagttctataaagcatccttgggaaaaaaggtcaaccgctacagcaacaactacaaaacaatctgtcttatttcaagccgtgtgtgagagctactagtcaggcactgctctttttagcttcatctgtgcccagggagattaactctatctgtagcagcacttgagaaatgctatctgccatgtaggatctgtgtgggatgcagatgaaaagaccagtagagccctaacacagtagacatataacatggtccttggggttgaattattttattgaatggttttgttgtacctctccctgaagctttgcgtaaaagaggtgtttttaaaaatttaataagaggaaatgtttttaccatcttttcatttctaaaattcttgttgaggtaatgttgaccctagagccttttgttaaacatcgttatttgttttgatatgtttccttgttgcaaagctttttttatgaagcaagagttcagattaaagatgaacagaggatttactgcaactagaataaggcgctgaacaatgttcactagcattcacatttccaagctctactagtgatgtgaactatatttagaaaaaagacacggggtctctttttttctctgacagtacatgttttctgtcattcatgcagctatttggtggttatatagtacactgctttgctcttcaaacagaaactttaaatgctactattaatcaggaatatcatttgcatacttttagtctcaactaaaataatttccccaaacttgagtcttcagaagataatgaatgccctgaatgtcaattctatttatttgatatttaaaaaccatgtcctttctcagagcctccaggcacatgcataataacataatccacagaagtacttcaagcagataaatgtaccacacaaccagaattagcagtacacaaatgaatgacttatgttctacctgggtagagcagtacaaaatatgtcattcacatggtggtcaaacaggagtatactcacgttcacttagggagttacaaaaatgaggacctaccatccattccattcatccatccatccatccatccatccatccatccatccatccatccatcccatccatccatccatccatccatccatccatccatccatccatccaaccatccatccgtccacccacttatttactcaacaaatactaacagtatgtttgctatattctaagcactgttctggatgtgtcagtgaacaaaacatatgaaggtgccagtccttgtggggtttaccttctaagtggggaagacagataataattaataagcataataaataaagtatatagtctgttagaaggtgataagtgctgtgaaaaaagagaaagtgcagtggggggatcggaagtactggagtgtgtgtatggtgtggcaggtgcagtattaaatagcgtggttaggggaagtttcattcagaggagaagatttggacaaagatttaaagacagtggattggctgggcacagtgactcatgtctgtaatcccagaactttgggaggccgaggagggcagattgcctgagctcaggagttcgagactagcctgaacaacatggtgaaactctatcgctactaaaatacaaaaacccagccaggcatggtggtatgtgcctgtaatcccagctactcaggaggttaggttgaggcgcgagaattgcttgaacccaggaggcagaggatgcagtgtgttgagattgtgccactgcactccagcctgggtgacaaagcaaaactctgtctcaaaaaataaaaaagtaaaaaataaagacggtggattggctgtgttgagggtgaagatttcaagtagagagaacaactagagcaaaggccctcaggaaggagggtccagcatatgttcaagaaataacaaggagaccaatggggttggagcagtgtgtgtgcacagagaagagagggaaccaggggccagataagtgagggcttataagacctggcaaggattgcctttcaatctgagggaaatggggagtcagggtatgcatttgagcagagttgtgacatgatctggcttacatttcagcagaatcactttgactgctgtgttgagtaaagctaataggtcttttcagaggctgtggaagtaattcagaaggaaggggctagtggcttggataaggtactaaagtaaaggcagcaagaagtagttagattctgggtatcttgacggtagaccagcataatttcctgaaacacaaaataaaatcatccttgttctctaacatggatcaggaatctgtcagtttggtggttgcagctgtgtgtcatgggtctcagcttgaagaggactgtattcgttcatcgtgtgtgggaacatatgggtgactggcagggacaggcttgcagcagtctgtgctcagtgaggattccaggggcctggaaagactctgctcagagattcaaggaataatagatgagtatcagagagaatgggtgattctgaatgattttaaaatctggcactctgactgtgccctggccagtctcccatggaccatcccttaagatgaagaggtttcaattaaatagctgtatcatgaaacatttttggacattgagaacaaaaggagtaggcagaattagcaccagcaactttgtcagcaagaagagatggtgccatattgcagatattggtgccctcaacattgggcaccagcagttggcaatgatggccactttggcaggcttcagtggcattggcagaacattcagttggcattggctaaggtgcccttgatgggaagacactgggtatcatagccagagacacagacatcagtacctttgacacattgggcacctgcagctctgaagcagcccttggcattcattagtggcagatttggcaccttcagtgagtatgaagaggactgagagcacttttggtaggtcctggtggcactgtctcaagctgtggtgacagaagacatcaccacaataggctagagcaagagaggcagaaaagggcagatgtctcatggtcagcggtagtctagttaacagtgcacatgtgacaggagacactttgaatgaatcattagaaggaatttcagtaaggcctagaatatgcagagaagtgttgctctatgattgttgctgttatcctattttgaagccctggttggagttcctgaaaaccccttttatatttatagttaagggataatctaagaactattccactaccattggagtgagaacagcagtcacaacaaaaaatagcttgatctttaggaaaatgtttccagcctcatagtctgttgtatgtgcgtgtgtgtgcatgtgtgtgtgtgtgtgtgtatgtgtgtgtatgtgtgtttgtcagtctagaatttctaattatctcagacaatggagtgactaagaatcttcagctctatttatgggaatccccagtagagtcactcttacaatagttttagtagttattatttatttaattcaataagaatttttaggcactatagtgcatcatatgtataacatcattctagatattgtatatctaggacaatatatatataacatcatcctagatattatataaatgcaaaagggaataaagttcctaccttccaggaatatgtaatttccttgggtatacatttgaaatacatgcaaataaagttctgtgtcacttaacaacagggatacatcagaatgtgtccttaggtgattttgtcattgtgcgaacatcagacagtgtacttacgcaaacctagatggtatcacctgctaaccatctaagctattgctcctagtctataaacttgtccagcatgttactgtactgaaaactgtaggcaacttaacataaattactaggtgatggaaatttttcagctctattataatcttatgggacctcttatatatgtggttcatcactgacccaaatgttgttatatggcacatgactgtatacaaagataagtgccagtttttataagttctagaaaaaaatgctagagtggattggaaacatttgggtgaatttcttttatagtttctcttggggttaatatatggtgaagtaagtgattgtatgtgtgcttgtgtgtacatgtttgtcagagagagggatgcaggtgggaggggtggggggcagagagagagagagagagagacagagagagagaaagggagggtgaatatggacatccatttctctttattgtccctagtcctagtcctagtcctagcaggcacaggcagcatcctctgtctgaagtgactccttcaatgtcctagttggctaaaaacacctgttcattctttgagattcagttcaagcaccatccacctgcccaaaaagctttccctgatccccatgcatttagctcttctctcctcttgtagcattttccacatagtattctagtttttgacatatctatctctgtctaaaatgcaggcagaactccttgaggcagggaccaagtcttctccatgtttccattcccatctctggacttagcatagagctgaaatgaatagacagtctgattgaatggatggacaatgagcaatttgctaatgaatgtctgtgcatggccgtgtgggtgtttgcagacgttatgcctctggagttgctctagcttcctttcatctacctctgagcctgctgggtctcgggacacaaggtaattgttactttatgtctacatcacgtggcactcagaaaagtgatctggctgaagtgcatgataatgtaattgagtcccagaggtgacaggcagggaaattgatctctctatatttactgaaataatctcttgtacatctgtggggaaaatttcacattcaaaactttcttatgatacatttacctcttagtatttagaaaattgtaaatacaatcctttgccaccaagcagtagcttccaagtaaagaaggggttgagggttaaaactaatataatgcattgaagaaaaagcttttaacctgtcaggactctgtgattcataaattataaccttagaaatcatttaaagtgtatccatttagcacttataccttcatgaattcatggaacaacaagtaaagctaaaatgtatttcctcttgaagacatgaaagaggaatcttgcagtttcttgggtactcgtttcctttgataagggcagtagttatctattaactgaatgtctatttactaaaatacaaagcaatagacttgtgtgaaatagtaaaaatggccagtcattttttccccaagatgagtaaattgatgggtgattccacagagtacagagacggggcactccagtaataggaagtagaggaaagcagttaagggcatagactctggagccagcctggccagtttcaatcctgactctgacacttactagtggtgtgacctcaggcaagttacttaacttctttgagctttaatttcttcacctgcaaaatagggatttaattttgagatttaaatgtgttaatttagagttaatctgaagtacttagaatagtgcctggcacgtaggcaattttctatttaagtgattgctattaacataggggtttggcccagaatgtctttctggcatgctgaggaacatcttggggaacgtgtattctttagatagagttcactatggatccacagaagaccaaccatcaggctagaacccaaagccaaaggataggtggaaggactactggtttgaagtagaaaatctcattgattaccgcccctcctcatcccccacaaaaataaccacaaagaaataccacgtaatgaaacagtgcttagcttagggaaggaagaatagtaactatgtcacttgtttagcctgcttcattaagctcactataggtatttgtttgggtttgaaatatttgactcattatagcttgaaggacaaagtgatgaatgaaatttatagctggattgatggcactagctgtatttcagctgtaataaccagaggatggttattacgaatgagaaaaaatagcatctctatctgcctgttagctaaacatatgctttggatcactttttgcttggagtgtcatgagttatcacaaacttccacaacaaagaagttttcttttttaactttgatctatgtattatttgtttttttagagacagggtctcattctgctgtccagactggagtgcagtggtgggatcatagctctctgctctctaactgctgagcttaagcaaagctcctgagtagctaggagtataggtgtgtaccaccatgcctggctaattttttaatttttttggagagacagggtctcactatgttgcccagccttgtcttgaagtccttccctcacgcgatcctcctgccttggcctcccaaagtgctaggattacaggcataagccaacacgcccagccacaacaggtaagttttaaaggtacataggaatggctttttgattcatctgtctccttctccaggaacctactcctgattccctgaacagaagagaccttcccttttacttaacgtacaaaacttgttatttttactcctattatagcttgtttcatgttctgacttgtactatattaagatcatttgcatattggtctgacttcctttgctagactaaaatcttcttgaaggcagatactgtgtaatttcatcttatttttctccttgcactgtgtcttgggacataagtaaatgctcaattcatttgcagacataacttgaacagaaatatctcacttgaatgccattgatggaaaataagaaatatagccaaattctattcaacaattaagttagcacttatttcaattgtatggtaaaggcaggtgacaatgccttattcaaaatggcgaatatgctgttttacagttttcgtgtaaatgcacacagttctgcttttctgtgaaatcacaatgcctttagcaactaaatggaactacactgtcaagatctgactgctcagcttctcagttcacttccattccattctatgctatgtatatttatattgagtccttgcttctaagagatgcagacaggaagatctctctgtattaggcttattcatttaatctctctcttttttttttttttgttttttgagatggagtctcactctgttgcccaggctggagtgcagtggcgggatcttggctcactgcaagctccacctcccgggttcaagtgattctcccgcctcaggcacccaagtagctgaaactaaggtgcgcgccaccatgccaggctacttttgctatttttagtagagacggggtttcaacatattggccagggtggtcttgaactcctgacctcgtgatctgcctgcctcggcctcccaaagtgctgggattacaggtatgagccaccgtgctctgcccatttaatctcttaaatagggaggcatgagttatgactttaaacaccttctcttctagcttctgatggactaaacaataatctttaaatacatttcaaaattatcagtttagtagatgacaatcaaattggaaagttttgccagtttcttatctagaaaatgaataactgcactgtgagaaacccactagctcagagtagaatgttcactatgcaatgcagtcatgggcatttttagtcacggactctcttaggtcagtaattgagttcttttctgttacttcttggctccaggcaaaagcaacatcaaaaatgtattgatttttgttaatttagggagaatttattgaacaaatgcaagtggtcataactaatattgagttcctctaaatgtcagaaacttcatatgcatttttgtatttatatctcacaatgacctaatgtgataagttccactattatctattgttttatagataaggacactgggattagagaatttaagtaacttggccaaggtgacacaagcagtaggtggctaaactgggattaaattagatttaactaaaagctcaagagagttattttttgagcccctgcaagattgcaagttccttaaagatgacttaagtggattatttagcttactcatctcattatccccttagtatccttagggtgctttgaagtacagcgtttagacaatacagtggggtggttaagaacctctgttaagccgcctcagtatgaattctagtttatccacctaaaacagcattcacagattcccatcattttctgtccatttcttgcttaatagttctccatagcatttatcattacctgaaattatatagttttacttctttttttctgggtccctcactagaatttaagctgcacgaggacagtgaccttgtaagtcttgcttcctaacaccaaattctcaatagctagtacagtgcctggcatgcagtaagtggtttaaaaatatctattgaatgaataaataaaaggagatacattttgcttaccgtttatgcctggagtcgtaattttcaatacaattaatgggccaaatgaaccctaccttttttcttggttcagcttcaaaccttctttttaaaagtgtatttaatagacactaatatagcacatatgctttggaaaactccattttatgtgctttacaaatattgacccatttaattctacagagaaggtgaaatcattacatccattctaaaggtgaggaaccaggcacagaaagatttagaaacttgcccatggtcagacaattaggcaaagaatggagccaagattcaaactcggatagtctgaccatgttcccaaccattccattatgctgcttcctagattaatcccataaaaatgtcatttccctggagtttaatgctctaaagatgtgtctttgctctcttagagaatgaccttccatcttgcctatttttccttcctctctacccagattaagaaggaaaataaattaagattattttacttattgaaacagcacagtatgctatcagtgaagcttctctcaggctaccttcaaggataaataagtgaatgaccccggtggctgctggacagctcacatggcctatatctgcttttcttctttttcatatttgtctttttcttgtatttctagagctcttggattcctgctgcaacccttccttctagccttgagaagggagttcagtggtccatggaggctgcaaaaactgccttttaagcctgaaatgtaaaaggaaggccgattttataaatgattcctgttcttgcttttagtcaattggttctttcatttcctgtcccttttcagtttctttcacaaacacacaagcaactcacagccttgggtctctgatatagcaccatattcactcaggaggcaattgtcatgagcacagatatctgggatttagttccagttcagttactaaggagcaatcttccttggggcaagtcatttaataggactgggacttagtttcctcacctgtgaaatgactccagtgagaggaagagctggagatttaaaggtcccttccagctctaaactgtgattattctttgacgaattatgtaaggaagggaaagtgctcagatatctaaagccctatttctctcactacagattgcaggataactccaagggagccactgttctttattaaatgggggtgaacttctcagaattgaaggatgacggctgctggggatagcaatagatcagaacctattttcctgcctaattccttccctatttctctgtaaatatcagaaggagattaggagtaaaagtgatatttcagctctgtggtctacataataaacgattccaagataaattcttaaaaaaaaaaaaaacactaaaaagttctgcctctttagcttgggaagaatgtagtagccatcttgctttgtgaaactgcacaaaaaacttggagcagagcatgggtaagtatgtttgaattgcgtgctctcacgcccagcagttgtttaaaaatctatccagcccatacagttattgcgattttgcattttgtacatatggggctttgtcatttcaaagggtgcaaagagcttcatgaacaatggccattccttctctcgatgtgaccccgtagaacagactagttattggtcatcacttgtaaacaggaagcatgaatctcaccctaggaaatgcaggccgccagtgctgtcatgcttacatgaaggacatgccttatccctttgtaaaacatttaaaaataaaggcactcagtttggaaatatctttgagcatcctaacctgacccattcagaactgacctctaatcagcatttttgtttggctcagtccagtctaataaatattaactgggcattactatgttcatgatctgtgtgctccatacctaggaaaggaagatgaacatggccaagatcctaatcttgagtaagagacaaattagtcaacaggtggtttttatgaggtgtaatgggaacacagaagggttaaatcatctatcccagagagaagatgttgtaaagatttctccaaggcttaagtattaaggaatgaataggagttacccatgggaagaaggatgagagttaaggtacagaaggagatgatgtttctggcacagaatgactagattctcaggaattctatcacatattcctaggaagagagataatacttcttggcctaatttgcagtttaatgagggctatgaacctgaatcctggtgaatcaaatgtgatttaaagtaagtgatgcatttcctgtcctggcaatagaacatcccaagtgatcttctatgttcctctctaccctgctgtcatggcagcccacaaagaactccaggatggaagggtccatgatggaagaagccagggtccctgaattactggttggaggagagctgcctgacccacactggacttagcatgtgtgagaaataaatttaacagtgttaaaccactgagaatttggagctgtttgttacagtggctaggttcattaccctgatcatactgtgtgccaggctaaggaataataaaagggatctgaatgacttgctgtcacttcaacatttatatagcccaaataacttaggtttttgaccttaacattgattactctttcttcctttctcatccaatggcaccaatgatttctttcttaaaaaggtgatcttttacagtctttcagcaagtcaactgctcctcctgagtatattatcagcatcttgtgtcttttaatgacatttgtctattgtatataattatataacattatatctattattatatctattattgtataacatatataatatacaacaaaaaatgtattatcgtatatataatatatgttttatattatatatactatacatttgtattataaaatatatatcatattgtatataataggttataataggaatataatatgttaatgttatacaatatagcatgtatatataatgaaatatcatttcaaaggtatctctatataaaaatcaatttttctcattagaatacacattttatgagggcaagggcttcatctatattactcattactgtaaccctagtgctaagggaaatgactagtatatagtaagcactcacagttattttcagaatgaatgaataaagataaatataatagaatagaggctgggttttttaaaagaaatggacttcagctgtgttcagatgtaggcgttctgaaggcagaaagagctccaaacccagacgagggttgacagttgctcatatgaaggtgatagcagaagctatgcaggcaaatgaaggcgcctcaggagggtaagggaaggaagaagatgagagaattaaggctgaattttagggaatatcaatgtataaaatagactaagtataagcagctaatgaaacaatattagaaaaagtaaggaaagtaaagagagtattgcggcacagaaacagaactctgtaagaatcacagttttggggtcagatctgtgagtacagcatattcaataaacacctgtctattgattgaaataagtgctgaacactgaatagcatatagtcccatgaagatggtcaaaggggctgactccttttctaaaagacatatagccaatgtcatccctgttaattatacacatttctctgggatgacatcaggaggcttgggttaccctggggcctttcactagtctgataaagtaggctatatttctgatctgagttcttccctgtttagaagattctcagaagtatggaaaagttcttaatctagctggatatttattgataagttacgggtcagtaaactatgcctacagtctaagcctggtctattgcctgtttttttaaataaagttatttggaacacagccacactcattcatttctgaatcatctatggctattttcactctgcaacagggttgagtaaccacaatataggacatatggccagcagagtataaaatatttatgatatggcttttcacagaaaaagtttgccaacccctgagcactgagcatatctgttttgcacccccggcaaaaaaacaaaaaacaaaaatacaaaaagcaaaacaaaaaaaaccccacaagacattttcagaactgagtggagcttgtaagaaccctgggaataccacagcctgtcttactaaggactggacctataggaaatagaatattctgtgccttcggtgagactgggtcccgtcatgtatttactttaggttaggacctccatgctaacagtgcacgtatgtgggtgtgagattctctttgaccgtgtatctttaactgatgtccactgggtggtaggccaacactgagtggcagtgagtttaagacatgcaataaaaagaataaaaagaaatgcaagtgaaaagaatgagggtagatggagagtgagtgatgggatgggagaatgaaaataagtcgccctgtcaaaaggtaccatgagagcatctatgcctgtgggctatattttgtcattgcccttctgaaaaataccagaagaaataagaacaagtttctatcatttttctaagtgacagggaaataagactgaaccttcctttctagacttttaaagaaataacattggttgtacacttttccgctaaagcgtacacacatctgcgtcaaccatcaagcctagaatcaataaacatctgaatgttaaggacttagagagcactagcgtctttaagagaatgactctgttctcttgaagatgctagttctttcaaggtccttaaaattatcttcatagaatgtctctgttctcttaaagactctagttctttcaaggtccttaaaattcagatgtaacttctttgaaagaatgtcacattcctaatactcctttcaaaggctgaaataacctgtgatctcatcatattaagacatttctagagtgattctcttcatctatgacataggggtagcagagtgacacctataaccaaatctggcccccaatgctttgttttgttaacaaagtgtttatgaaagaaacccacagtttttttggggggtgaggaggggcaggacttctgctctccagtgtgccacagtttccaccactccatattgtcttttctttaaaagtgtttgagttttcaatccctacaatctctgcccacaccattttgagggggccaactgttgctttgatctattttcttcgttcaggcctaaaattaaatgaccacttgtaactttctagctatgttagtttattagaacccgttttatttgctaacattcttcaagttttgtccaatagagtttagtagactcactgacctaatatatatggtaaaatactcttttcagtaatgaggcaacaatgaagaataaatacattttaagaaactgtgctgttttatgggattactgatttgtgtatatcacttagatcagtgatgttcaggttatgaagtgattatgtacaatttgcaaatatctagtgtccctaacttctgtattatcttatatcatgctacattatacctaactctacagaccagagacatgtgcctcttttttgagtggcagtagcaaaggtggctcttaaatcatctgactgtgaacaatacagtcccaggaagatggcccaaggaaataaagggtgtttttttccttgtagtttttgacggattattccattttaactacaaatgtggacaatggaaactaggctgtaaagtagatcattataaaatgtacctggccaacttctaagatgtaccccaccctgcccgccctaccccatggtccccaccgtctggtattcacgcccttgtgtaaacacctctattatgtatgaactgaatctggtgacttgattgtaatgaatagaaaatggcaaaaagatgggatgtcacttgtgtgattaggtagcaaaagactgtgacttccatcttgctagcactttcttgtcttctcacttgcttgttctgttgaagctagctgcatgttgtgagatgctctatgtggtgacaaggaactaagggaggcctcagccaacagtgtgtgaggcactgaggcctcagtccgaaaatccctaagagcctgaatcctgcctacaaccatgtgagtgagttaggaagtagatcctcttgacttgagtcttgagacagctgtagctgtctgaaagatccagagacagaggacccaatcaacattgtacctggattcctgacccacagaaattgggagataataaatgttgttatatgccactaaaatttggggtaatttgttctttaacaatacagaatataaatcatctattggaataacagcaaaaatttttttagccaaagcctcaaactgaggatagagaagggggtaatttaatccattcattcagaggttctcagtgccattcagtgaaaaaaataaatatatgtagctccaataaatattggttaaactgagcagaactcagaagtaaagggccactaaaattcaggtgttcattatgtagtaaagtaacagtagcaatgaacaaaagtgaataccagacgtcgcactaagatcaagagtcctgtgataacaatatttactagtcatcaaatatttttgggtttgagttttgaggaactccaggatttaaccgaggagaatgagtaggcagagagacaacagcagagatgcagagagtaactacgtattgtggaagccgaaagaagacaatgttaatagtgaaaatttgccccatggggttaacaagaatccttgagcttgccttgcaagaagacagacgaagaaacagcttgttataattctctctgcttgcaacaaaactggctgactggctgaaactggctggaaccaataaggctgactggagtcagaatggcacagaatagactcgctctcctggggggtgacgttttgatgtcacagcctgaatttccacgtcatgtttcagaccagttccccatgaatttgcacaggcaacccacggaaaagcacgaagggacaactgcgcatgctcaacggactttccaaacttcccattcctttctgccaatcactaaccaaccgggaagccccgcccccagaatctctcccttaaatataccgctttaaggctggtacagggcgacggatttgaactggattcctgcctccttgcttggccgccttgcaataaacctttctctctacaaaatccagcgcttcagtgtttggccgcaattgtgtgcaggcaaatgaacccagtttggttgataacaataattgtcaatagtatcagagtctgctgaagtcaaagtagggtggagataacaaagggcttatggaatttctgatcttctgcttactggtgaccttagcactggttgtaggaggtcgcagcagagaaacaactcaagcccttgagggattagtggagcaaaggaaatggggagacgttgagtatagacaactactaagtaattccaaaaggtattataaaactggaaagcattagaagaagaaatattgaaaaacagcgtgagcatacaatataaaagttgcttatgtgctgaaatatactgtcaactcaggttgagggatatgaagagagcagatgcgatatgagccttgacacaaagtcctgcaaacctttaaaatgaaaatcctttgaatgcctgaccttcaggtgttatattatcaaaggacagaagcgtttatgcccttttaaaaaggaaaatgtattagaggattatccaaagacttggccacatacaattcttttctggaaaaaactaagttttatgttgaaaataagtaatcaggtaatatccctgtgtccaaagagacagaaaaagcacaataaacttaacatttctaggacagtagaaaaaaagccattttcttgtggaactttgggtttgtttcctttcataaaaagggaaaaaggtgaaatttgatcttcaagaagtccaggaaagcttttagagctgagaaaagacagagttggggttggtgagggaagtagactctgggtgaaaacggataattaagctttacaaaaggtcaagcattgcaaaagacagcgagaaagatgcattctatgtgttgaatgtatcaaatgtagttgagaagatgtaaatcttcgcattggtgaatatttcagtattaaaaaagacatattaaagaatagctattcttacaaaaggaataaacttttttctttgaagcttgacacaacatatacaaataaaagcatgaaaaatatgctttgaagtgtgctaacacatcaagattgtactgagcaaagcaccttttctctgtttaggaacaatctcactaattccacaacacaatatgttaattaaaggatcccaggtagcaatcatggaatatttcttctcatgacagatgaagaatacaaatattctgaagactgaaattgtataaacaaaatgaagagacattttgtccgttttctggcagtgcaaagttaaagtgaatgcagatgaatgtgctggcaataaaatgacactattaaccatctgaagatcgggctcattacctaagaaggcaaagcatcaatttgtggcattacaacattctatttgtgctgctcaatgtgcgtctggatgtttttatatactctctactaatttgtgtgcagagtgagctcttctgcatcagcctctctatagaagcttaattttgtattgtttctcttatattattttctctaatgagaatgatattctgtattagaaataaacacttcatttattcttcaaataattctacgttcagtttctcttgttttgcattatcaagtggtgtgtacaggattacagatatatcttaaaattgaggtgctctgattaaaaatatacatttgaatgacatgtgaggaaaatattcattcactcagtcactcactcattcattcttaaaagaatgtctatgtattgggttaagcatcatgggaaattcaaggatgttgcactgtctctgccctcaggatgtttatagcatagaagtggctgaatgttattagtaccttgagataggaacaaggacagggccataaaatctcagaggaaagggaaggtcagtgtattttctcataccacaagtattacttgggtacctactatgtgacaggtgctattctagaggctggatatatagaaaagagaataagacagtcaaggtccctgaccttatggaccttgcttcctgagggtgagatggaaaataatgaagaaaaaaagcaaataaataatataacttcagatcacactaagtggcatgaagaaaaataaagcagagcaatagcaagaacagtgatggtaagggaaggatgtgaattttagctcatgaaggcccctgtgaagatgtcacattcgaatagagatttgacaatgtataggagcaagtgtatgaagttctgaaggaagggctttctaggtagtgggacctttgtaggacaggataaagactttattctaagtgggaaggaaattcactggagaattgaagcagggtatagcatgacctgatttatattttagaaggatcattccagatactgtatagaaattcaattatagaggggtaagaaggtaacctggacagaggttaagcatctgtgaatagtccaggatagaggagaacaatgagaacttgattcatgtagtctaaccaaggatgacagactggaatgcactgtggtagtccatctagatagaggtggttggtgaggactaggttgataattacttagatggtaaggagcggttccattttgaaggaagttgcacaaaggaagtgatatgatatgataatatctgagttgaactttaaatgaatggcagcatgtgacaaagcaagtagtcattcatggatttgttgagtgcttatctatttttatgaaccaggcactgtgctaggtgctatagatacagcagtatggaagccattgctgaaagtgagaacaacaaaacttgctgagaaggtaatattttaagtaaacatacacaagcagagaggtgaacaatatgctcataggaattacttcctgaattggttctaaggatgttttattcttttccatttagtgtagaaaattatgtgattaaactcctttgtatatttggctcagtgaatttgcaaaaggagtaagtgtctatcagtagaaattcaattcactgtcagttgggaaatttcatcagacaatttccttagaaatagtggctaatatttacttttcccacttagggagggagaaagtatagcctctctagaaagaataggaggataggagagtacaaaacctaggacaatctcaaatatccaggtgtatctattacagttcatctgccacctgcctccaatctgccccacagtctttttgcaaacagatgacccaacttcaactttccctccttctaatcccacttgtacactgcctctagaattaactggcctaaagtagtccagtcatgtccattccccagtgcctacagaataaatttcaaattcctcagcctgacacacactgacccaacctactttttctgctttatctctgactacacacttctcaattgttttaatcaccttgaattttcttcctctttttaaaattattttttgaattgcatgaatatgttatgaaatacacataacataaaacttaccatcatcgccatttttaggtgtatatttcagtggcatgaagtacatttgcattgttgtacaaatcccattggattttaaatgtctatttccctcatacttccagcaatttgttgcctgaaccaaatttgtttttatatggttcctggggcctcctgaaatgccttttcccatccaagtactaaccagacccgaacttgcttagcttccgagatcagacgagatcgggcacgttcaggttggtatggccatagatctgaaatgcattttcctttccttatcaattaaaatcccacatatctgaaagattcatgctcagattttgcctcttcctttaggctactttgacaccttatctggaaacaggaggtcaactctgttgctaggtaacacactgcttacagtaaaaatgatgcctggttggtaaattgcatctggactaggagggcctatacatgaactataaatacatgatggggatgtgatactttggacttccctgagtaatgactcgtgtaattaggtcccttgtagggaccatggaggataagtctatggagttgttgcaggagatatcgtctcttatggggcaggaggcttttaagccagggccattcctgcacccacccaatatgaatctagtcttcttgaacctgagctgccacctggggggccagaactgatatttgtactgatattaggactctcactgaagagaaaatctgaagcttccctggtggccagcagtgttttctgtatcacatttttctaggtaaatctcaagctaagggttcatgcctgtaatcccagaagtctggaaggccgaggtgggtggatcacctgaagtcaggagttcaagaccagcctggccaacatggcaaaatcccatctctactaaaaatacatacacacacaaaaattagccaggcatggtggtgtgtacccataaccccagctactcaggaagatgaagcaggagaattgcttgaacccaggaggtggaagttgcagtgagcctagatcataccattgcactccagactgggtgacagagagagaccttgtctcaaaacaaaaaaacaataaaacctcaagccaagtgtggcccatagtagtctcataagtctgaatgtgcagttggacctaagaagatctgctcttgaggttgcatcaatatgtagaactactgtactaaatacaaatactccttgcatgcctggactcaaaatcactgggaaccgtacacaggactagggcaataaaagtattgctcacctttggaaggagctggattgcctgtagaattctttgtctgtgcccagaattaaggattccaatttccaacaaatcctgatcttccataacattgcttccctgaaacaaaacagaaatgttacaagttaaatcaagcatttatactgtggataaataacaaggatttatttaatacagagaaaaccagtgagtgacctgatttttatgaacaaagacatagagtcattcttccgtgagggtgagggcagagtcggtcaccttgttactgatgtgaagtctaggagaaagctcccctcccctcacaaatatctatcgtggcttatatccacatggggttatctgcactggagattcattcgtgtgacttaaaactttgtttctgcacattgtgcacatgtaccctaaaacttaaagtataataataataaaataaaaataaataaataaaaaaagatccaaaaaaaaaaactttgtttctgtaaaaatgtgaatgcttctagtaagagttgccatttaagattatcagtgacttacacattgatatgaatgaatcatttttccccccttgatgacagattttgtgcggaaggctgatagaaaaattgacatatattaggcaggttaaaagtgagagttaatacttaatttcaaaatattgagtcacaatagcaaacacatagaatcaacctaaatgcccatcagtgatagcctagataaagaaaatgtggtacatatacaccatggaatactgtgcagccatagaaaagaatgagatcatgtcatttgcagggacatggatggagctggaggtcattatccttagcaaactaatgcaggaacagaaaaccaaacaccacatgttctcgcttataagtaggagctaaatgatgagaacacacggacgtagaggggaataatacacgctggcgcctgttggagggtggaggatggaggagggagaggatcaggaaaaataactcatcagtactaggcttaacacctgggtgatgaaataatctgtacaacaaagccccatgacacaagtttacctacgtaacaaactgcatgtgtactcttgaacataaaataaaagttaaaaaaattattgaatgccagacaccagatcacgatatgaagattgaatgatgaatatgatgcagggccctacccacaactgcctttattccttccagtcccgtgatggaaagggactgttcaaaggcagttaggtaggatgctgagactgtgctatgatggtgacacttgcttaggagtccagagggaatccagggtattttttcagagaaaaggacatctaatcagatataggaaaaatgggtggttaaggcatagcacctaaaagaggaaggacaatggggaaattatgtgcaaagacctgtgagtaagaaggaatgtagtatacttggaagcatcatgttctgggataatatggagagaggagcaaacggtaaggctgaatgagtaagcagagggcagaccatacagatattgcatgccatgctgagggcttcagactttatcctgaccataatgggtagccatggacagcttttaagaaagagagttacatgctgagattccaaatttagaaacattattttgatttctggggctgggcctcagtttccctacctataaaatgataaagttgagcccacaatgtccaaggaccagttcagtcctaaaattctgatttcaatggttattttaaacctgtgattaatatttgaatgcagaagtttacatattgctcattttatccctagattttaatctttcacggtttgtaagacagagtttctctttaaattgaggcgtctatagaggttcaagaattcagatcactattttttttgacaaatcaaactctgtcctacttatgtgtaacacaaaaacgcaagaatagaaatgacagaatatccatttatttagtgatgagtaccattagacactcaaagcaaaggagaatgaatttgaaagggtgattctggggcatggagaccactgtggttgttttctagaggcgctgtgggcatagactaacgtagtagtcacaggagcaaaaagaagcaggtggatttgcaaactatcaggaagtttgacgtggagattgaacatgtggaatgatgcagaaatgtggaatacacaaaaattcaaggcttgggcagtgagtggaacttgatgccttttcctgccataataaaggaggaagaacagccctggtggggcgcaaagtgagactaacatctttccctggacagggacagaatagatgcatgtaaacaacttaataatatcagactatgctataaatggataactggctgtgcttagaaggattaaagccactggaatggcacaacagctagggatttaaaacgggcattcactggacaaaagcattccacctactcatagtgtcattcttatgcttaagcaacaccagccatctcggaggaagcagaatgatccaggtattcagcagcatgataatgaaaagcctaatgaaaaacaaataaagccagtcttggcaacatgccacaggaaatattgctctcaagaaattactcagtgcacacaacagagcatggctgagaatacaaatgacttcatttagagaaagcgttattatttccagaaatggactagtatggcatgagcgagatatgtgataccattctgacttttactctttgaggagttacctggcccttaagaaaaaatctttcgtcatctttgtgctagaacattaccaggttttccaggtcctaacttaccaacccacaacttcagcccatgtagaatagaggacctggtttttttgcagaaacagaaagcatacgaatatcccatagtgtgcatagctactatctctaggtaatcctgacaactggatttcagtgtttgaatactgaaatgttttggtaaattaaatcctaaagatcactgttcttcctctacacctccaatatgctattttctgtatctcagtaagagaggagtccttttgaagaattatagggaagttagatatttttaaagaaggtgttgagtacataagaacatctttttgagccaaatttcctagcatataggataattgccaaacatttttgaaaaatgaaccaaaattatgggaagcacaagaaaaatagtgaaaatgtgtcaaaggggaaatggcactaattgggaaatggaaaggaaaggatttactgtccccagtgaggcatgctgttagaaattttctattttatctttttctataatacatagggatgccaaaaatatcctagtacatcattcagccagccttttgtccaaacactaggggacttggagtctgcagaactgggtttggatcatggcggggcaaacttggctaagtcatacattctttgtaggcttcctggtcctcacccaccaaatgaagcagtttaatgaatatgtattcagtttcaaaatgctatgatttcagccatgtttgatttttggttggtatcattatatataaatatagattgtatattttgaaattatgtttcagtgtttcagaatttgtaacctaaaattagctttaagaagtgattaaagagaaattcaagaatatatatttttttttgacaaatcaatcttggtatgatggacttataaaatttcttattaaaggaaattataaggtaacttatttttgtagtagtacggattcttatagcttttcagggaaaaacaaaatgtttcaaaccttataactatctaaccatttctttggcacctgggtgacagttgtgccatcaaagacaataaacattcccattcttcctagggagctggaattaattctcactttatcacttgcctttactaaatgctagcaaatctcagtttaacttctgttttttttttttttttttttttttgagatggagtttcactgttgttgcccaggctggagtgcaatggcacgatcctggctcactgcaacctctgtctcctgtgttccagtgattctcatgcctcagcctcccaagtagctgggattacaggtgcccgtcaccatgcctggctaacagggtttcatcatgttggccagggtggtctcgaactcctgacctcaggtgatccatctgcctcggcctcccaaagtgctgggattacaggcgtgagcaaccgctcatttttctcaataaaaactgaacacaactctagctttcttcctcctccatcatttttttttttcacataacttttaggtcaatgatttgggggcagagctccgtcatgtccatcttctgtttagtcatctactacactgcactctcaatctcctttcctacccagtacactccagtcccatgttttcatctcccattttcctcctcaacccaccagaataagctgttcccccccatcaactccatagaacttctctgtcaaatgttaagaatgacccctcaattgccaaatatagttgattcttttaaatcttgatttcaagaatttacttgccatatgtaggtgatggccaccatattggacaacaaagatacagaacatcgccatcattgtagcaagttccattagacagtgctactctacagttagagacattgaaactttagtcaaatcacaaaaatggggcagtagcagggaatcaaatcagggactcaaaaatactcatgagtttttctcaggatgtagttattcatgtgcctcttagtcaaagttcatgaacattaagtttaggatctttagcaaattctcttttaattcttcagtcaccaaaagaaattagaaggttgttctactttcagcaacatttctttatggtggggctataaatctatgctatgaaaatgacaagtccaatcactaaattatttttgactttcttagcatccaccaatcacactgcataaggtgtttaaataacaataatcaataaataaagttgtttagttaatgactttctagaatgatcaaagacccaaatgcagtatttttagaatagctgttctttgcctgtcaagaaatgtctaatgcagggtgtctttattgatctcttaaatcatggaatggaaaaagtcacctaatgttttatgcactaatagctgaaagtggaagtttctttgaccacggggagaatatcttaggtactgaacttcttcagctgtgataaactgttaggatgcccaaatagaatgaaaagcagtgttttgtatttaattattcattagaagtaaaacagctatttaccaaaaacatctcaaaaatatctgtactgatggctctgtctctccaaactctgcatttaaaatttcttgtagttttttaaacttaatacgatatcttattcatttagcaagctttccttcatattatatattgtagaaaatgttaggaaaatatatttaaggaccacagggaactggcttattcttaatataaacttgagttggataatgttatttattctcttccttcatccagtccaagactaaaaaaatcaagatgatactgttgattggggaaacttgtttttgctctataattagctaaattagattcttctccacaatttatgtgaccttaaatatttaaaatagaatcactgtataatagaatgacagcaagatcttacaaacttacacatagaaaaacatgtactttagtttgcttttaatatttagccttttataacataaatagcatggtagcatgaaactgtacataattttcttggaataacaatgctacctctctgcttctataaaagctttgagtcaatttgatatcaatttacaagtaaacccaatgcatgtcttctctgcatgattatgataatggttattgtgctaaataccagatttattattcctctgtcagtgttggaacaaagctttatttagcttatcatatagaaacacgggtgactataactgatcagataatggatgatgtgcttcttccaactttaacttcctctctcacattaatgaaatggcagtggaagaaaattctatagtacactaaaaaatccctctaccctaatcctccatttaaacatattctgtctaccgcaataaaatttcttgcatacaacttaagtaaattttcatgtttttagcttatgaagaaagctttctggattcttcagactatgtggactattgattcaaaaaatattacatcactgaccaataagacatcatcttatatgtgcaagctgtgtattttaataaattatatcttaaggttaagatatagtttagcattatatatttaacagctaccatgattacaatgaattttctgtcaccgattttttcctctttatttttgaaacccaattcccctttgaaacatctgttgtcaagctacagagaaagagaaggaatttaagtaaccaggtatttatttgttaaagtatcgagcaggatttggtgatatcataaattataaatgtaattcacttgagatgtgttcatgtaggttttagaattatgtgtatttgtaaaagagtgcaaaataatttatacagtaatttgtactgcctttggtcaaaaattttatagctatgagagaaggagcctattcttcatttttaaggatgctaacccagagctccttcaagtaagaagaaaagttgatgtgaacaaaacttttttgtatgctcttacttctctccagatgcatatatctgtataaatataaagctgatgaatacctactgtcttccttcaactttcacactgatagcagttggtgttcattagtgtaaagtaaatagcacacttactgtgtcaggcactgttctaaataccttccatatattactttatttaattctcacaataactcctatgaggtaggtagcttgttcccatagctgataggagactttctcaagacttaccctatactacctctagcaggaatcatgcaggagataaaaggttgagttaaaaaaacatggttagatccacaccatttatatttttacttcagagtcatctgaaattcacatttgaaagcgagtgttccaatgcatttatgtttgatttcacagtaccgaagcaacaatgaaccctctctatggaagagaacttggagagctgtctggcctaatcttccctgctttgctccagtcctttctgttcactgaatcctggaatcaggcttggcagggacctggggggtttctagtttctagtctaaacgttccctaactacccacaaagcttcaacttctcttttgaagtgtggtgtctcactgggttgacaccatccccagagaggtagggaggatattaaatgctttaaatggtctttcccagcagctgagtctgagcagggggtgcggctggggttggggtggcacctctgtcctactcttttagctcccactgtggtacagaccaagtgttgcaggagagctatctgaagaagaacgtgccagaagcggagatgaaaggaaaacagttagcagctgtcctgtgtccttttgtaatcacaagctgtgaagctgaaaaaaaaaaaaaaaaaaaacttccttgggtaggctgtacataatcttggcagatatctgagtgttgttcttctgtctaatatgctgaacgtttcccagtgcctcacaagagaaaagtgagacagggttaggtgagtttggacaccttgctccgaacaggcagggaacatggcgcccttgtacgttcatcaagctcttgcaaatgccctgtcactgtagatgctgatgcagagctccaaaaggaagggctcctctgcaggagaagcaaaaagaatttgctcctgggtattcccaacacagccacatataatgacgcagaaagaagtacctaaaaagattaccagccattacattcactgtgtagcaggtacttcacccaccttatttataaaccttacagcactcttgtaacataggtggtattattttcatcttatagaggaggaaactgagtctcagagatgtgacactatggagtcaagttcacaagataagtataggatggatctgggatctgtgttttatttggtcagactctgatgctgatgcttccttcactacataaaaagaaccaaatgtttagtaggggacattttctggatggagattccggtccatagatatgtaacgttaccaagaagttactcccatgaccctattttcacacacacaagcttacatctatatttacagaccatagggagtgactgccagagtttctccaacacattgaatttcacataaattatttatcttctgaaaggtcaactggttagttctccttctaaactaccttagtgtattccagaaccaaacatgttaatcaaagtgacccaaggtgtttgtggctaaagcactaactaacttgccatgtttcctgctgtgaggcaggaagtatcagcatggcattaggttgttgtgagagattcagctcttctgcagtgccttgtcaaacgacctgactggtcaactgggaaaatgaagttctcagggccaacatcgtatttgggtgtttttcttttaggtctgtatcaaagccagatttaagaaggagggtgtctacaaatgaacgaaagcagaggatgtctggggacaagctaaggacatttgtgtcccacactgcatgtattctgaatccagagaaaagagagtgagttgcagtctcctgagaaggctatccaggctaaggagcctgtgatggtgaaggtggataatttagccctctgagaagtgtagacctgtcaaaaaggagattcgttaattcttcaaagatatggttgtcttcaaagaacagacatccccagatttaaggatgatggggtctcttgacactgagaactacattcagaaatagccaaacaagaggaaaggagcaaagaggaagagaaagggagggaggaaatgagaggaagtgtttattcttaagggtgaaggtagtggtgaagggagtagaatttcctgataaaatacagaaattcaaatttaagtggcatcatgtatttttattcacttaatctggctgccttagacaggaggtcactgaaatctggaaatgagctggcagagtccagtccagagctaccactgaggcaggcattgtcattcattcatgtagtcagcatttgtttgttcaataaatattttttgagcatttattatgtgccaggcactgggctgtggttgtgagatacaatgagatcaggacagacaaggtccctctacctttagaatttacagtctagtggagaaaaagggaaacagtggaataaaaaaatagataaataattatttagcaaagttttactatataccaagtatttactgtattagtagggactattaagcactttgtcttgtttgttgttcatgataaattctgatgttagtatatacaattattatccttatttacagataatagactaagaattgaaggcacagaaaagctgataattagtctaaggtcacacaggtagtaaaactgacataaagggaatcaatggagttctaaaataaaaaataaacaaataaataacaacggagatctatgttagaaagactggtgaggaaagtctctctgagaaagtgacatgtaattaagacctgaggggattagaaggagcagcctaactgtgagaagagctgttacaaggacattccaggcagaaataacagcaggtgcaaaggcactgaggtgaggaaaaaggtgaggcatgttttaggaacaaacagaagcctactaagaataaaatttagtgactgagggggacgaagacctgggaaagaaacgcaggaaataagacaatacagagacttgcagactctgataaggactttgattgtattccaagtgcaatgggaaacattgaaggaaatatactaatttgcatcttcaaatatactctggattcggtgtggagaatggatggagaaattgggaggtatggaagttgagctcgacaatcaaaattgaaataacagcctagaaacataaataatctaaaggaaatgtgatgaaatatgaccttttgggagactatgggaatgggtctcactggggggggggtcaagtctccaagccaaatgcatcttttatttgaatcaaagagaaaagccatatgacaaggatgaaatcagaatagtctttgataaaggttctatgtggatacaactatgaataaagatttagcagtacctacgaaaatgaaaatgttcagactccatggacccagcaattctgtttcttggtcgtggcagacattgctgggaggctgagtcctttccctctcactacctcccactgcagaggctggataagctaaagttctcagcttccctttaaagcaatggttgaacatgtgacagaagttgtcattggggaacttctggaaaagcttttgctttcctaatgaaaagggaaaaattcacctgctacccttctgtgcccataagaaaggactctcctcaggatgagtggctaaacagttcagagaaggtgacagcgatgggcccacagtccttggacctccaatgatagatatctccattggatacctggaggcaggcaaggataggccatggaagggttagttctgcataaaaaacgttatttaaagctctctccatcttttgcatctaagttgctctgactagtgtttatctgtcagtgaaaataatgatggggatgtgtactgtggcatgtaattaatagaggttataatggaggcaacaggatatttactatttattttaggcagacaggggtatgataacataaagaatagcagagaagggatactaggaagaatgaaagttatcagatccaagttggggtgtgtgtgtttgtgtgtcaattatagcattgcctcttctcattttgacttaacgttgtgaatttctcataaaaagatgacttgaaggaatttctttactctggattttggtttctattaaaaactaaaacggatgcaaaattgccaaagtgctcatgggactaacaggttctaaatctgggagtgggtttcagcttataattgaagatgacaggtgtccagagattgtatgaagttatggttctaaaggaagtacagttttacataaacctggtattctacaggaaaaaatgttactcttgaaatccaaacacattataatcataacagggcagaaacaataagaacatttaggggtatgttaggttgaccttagtgtgtagctcttccaggaactcttgagaagtcagagtttttatttaggtcctttgtaatctggaatgcctttggtgggcagtgaatggcgattattgaaagagttgactgatagaatattcctgacttttccccacatttatttttagttttggttttggtcttgaagacatttttcttaagatgtcttcaggaaaaaaaaaaatttttccacattgaaaactttgttttggctttttcgagtttaaaattcggtgatgggaaaacttgctcacatcacaacaatgggattaagtgtgaggagatgatcgctgtgggcagacaggcaggaggctaaccccacgaagggctaaactaaaagctgagtaagagctccactaagaagagctctttgaactgttctgggactggctagggccactaattgtccttgggttgtatatgaagggaaaatttgtatcagggacacaaatatccttgtcctttgtatagcatctatatcatgaaggatattctcattttttaactccattttcttcactgaataatattactcaacctgaaagaaatacaggggaaagaaacggagggacatgcattctcacagtgaatgtaattaaatgtcctcctgtctagtttttcaagttaaaggttctgagttttgtttccagaatattcaactggtactaaaagcatcatgaagtccctcatatttaattaaatggtgcattattaaaagggggcacactctatctaggttaaagaggtgataaacagctatagaatttcatgtttctttctacttggtattatatgtcttgtttcctttactggacagcaaacttcttgggagaaaggatcatgcctgaagcatctttgcatctcccctaacatctgtttgctaagtgttgaataaaataaaagcttgaaagaatgaatctgtaagtaaaaacatgagttttttagatttattaaaaaacatttagtctaaagatcactaagtaagtttataggaaaagcactgaaattttgagctggaaattctaatatgcaggatgcctgatgtgtttttcccccctaattgaaagaaagataaagatggaattgctggtacaccataacaccaaaatgttcttaatttttttttcagttttgcaaattctcatgatttgattttcatccaggactgtcagttgagacatctgataatctaaaagcattcagagaattaggatcccatatggctcgaaaatatttcctatccggcaggaaaaagagaacataccatgaaaataatactggtatatccttcaatttatgtgtacaaggagcataaataaatttaaatcattattcaaagtataataattataatgatcataaggttgattataacaaccaaaataaaaagaatatacagttcttcataatcatgtgacattataaaaaatcagaagtatacttcaaatcaatgatagtaatagagttgtgtttgtctaacagaagcaacagtcattagaaatgagcacgggattaggagtcctggcttatcactaattaactgtataaatctgaaaaggtaatttaactcccttaggtcttaattttctcaactgagccatgaaagggctagaccagatgttcccttttaacacggcatctgttctggaggttctaacaaggagtacatctactcatacactcctattgcctgaagaataattaattcttcttgctttgggggaaatgtcattttcttcagataagtgttcagtattgagaggtgcacttacataatggtgagggagcaaggagacctgggcttagtcatctaatttcaccaacaaaattattactaacaataacaataacggctattcattgagagttaactgcaggccagacactgtgcttttatcctctgaacaattctataaaatagatatcgctattatcatccccattttacagatgagaaaatggaagcataaagattactaggaacttggctgagatcacacagtaagtggcagagctgctttggaaatgaagatgggtgttggaatcaaattcccctcaccccactggcttcccatagctttgacaagtgtcttctgcatggaattgcctcagagatctgatggatggagtctttctctgccagcccagtcgtctccatgaacctcctttcctacaatttctacccagggattgaggattattaataaaaagaaaaggaattgagtgctcctgggttcaccttacagctctgcactttaatagcagtgtgactcaggatcagcaatcctctttctttgtccgtacaatggggataacactaatgcttatcttttaaggatatggtgacataatgtttatgaagttgctttataaactctaaagtaaaattgctaaaaataaagcatgcctgctaggaactactttttttttttttttttttttttttttttttttttttttttagaacatagcactgtaaatcttctagtttcatgttgtttttgctggaaatagtctattctgaaagaggcagcatgtgtgatggcagaaaaattcagggttcccccccccacccccagctctgccatttacttagctttgtggccttgggaaagtcacttgatctggcatcccacagggtcccatactctacaggccctgcatttggggtttaatttctgtggttgctgttttgaagttcttcctaatttttttctttgagtttgtgtgttataagtgaagtctgaagggacaacggagcatgcgctgggcttggcaccttagatcatgggaggtcttgcttcctgctgcatctccaggatgggttctgccagagaccctcttcattggtctctctatctttagtcctgcccaacctccctttctctgttgagtcctaaaattgctgccatccttcactcctagcaggagtctgggtgccggcagagggagggcttgggtgggtcactcaaacccatggcaccttggggccgagcatggcatcgcccatccctgccctaacaggtagcagcattccaaatcaaatgggtgaccagccagaagctatcccaatccagatatcaagcatgtcctgatgaagagatttaaaaatcctttgcggggtgggggtcccctgtctgctatggatggaggtaatgtggcactggataaaagagatgcctggttagattttctgggaccctgctctatccaggacactgtggtagtcaggagagtgttgggggcctggcagtggggcacctgtgccctgcataggaggcacggtccagggtgcttgcatggggctgcactctcactacaagtgtcttgtgccttggaatgctcctttggctagctccatgcctggagcattctccctccttctaaccgtcctgggtttggcctgtatttgtcttttttgaccagatcaaggcatcctttggataaaaacacaaaatataaactggggaatttggtattccttcataggagttaaatgctttaatattttcatctaaaagtaacattgcacaatataaaaatgaatgacaaaattcatgctaataacataaaattttaatgtttctttacacagaacattaaatagtaaacaaaaaacaccatgacaagtctaaagagagaccacaaaaggaaggaaaaaggtttgtacgtatttttaatggcactctttcccctgccttttgaatagggggccccacattttcattttggactgagctccacagattatgtagctggctgcgctcccaggatgtaaggtttgcataatcacctggtccttgcttcacttcacaggtatatttgcagcagctctgcttgtagttggtaagctcagttaagcaacatagttggactgacttaagaatagcttaccatccaatgatctgtggctttatctttacctttccaagtgggtagaaaaggagtaatgggagccattcccttggaaactactgaggtcatttaaccctaacaaggatgatgcttcactagatgttaattagagatcatttccatttttagttttagttctagaggttgccttaaaaattatgagggcaacaggaaacactgaacttgcctagacttctggggcttctttattcattgacttattcattcacccattcaatcattccctccttcactcacactatcatttcacaacatttactgaagtgctatcatgctgcccacactttaagtatggagaattcaaaagtgattgaggcagtctctctcctaaagaagctcaaagtcactgggggaggggtaaggtggaggtgggatcagaaggcatataaagagattatttttattattgttttgagacagagtcttgctatgtcacccaggctggagtgcagtggcatgatcttggctcattgcaacctccaccctccaggttccagtgattctcctgcttcagcctcctgaatagctgggattacaggcacatgccatcacgcccagctaagttttgtatttttagtaaagattgggttttgccatgttggccacgctggtctcaaactcctgacctcaaatgatccacccgcctcagactcctaaagtgctgggattacaggcgtcagccactgtgcctggtcaaagagactatttttttgatgcagcacatacaatgattatggctgtacagagaaaagattcctgaagtacacagctttggatcaggaaagacattttgggaagcggaacatctctgctacctgctaaatgatgaggaaaagttaaccagaatacaggcaatgcttgaagcaagagagagaaggcactgcgtggatcggttgcagcatgaacaagggcaatgagaaaagaaacggtatagtgagagtgaaaaccagaaagcagtttacagttaaccaggtggaagaaacagggagggagagaccaggtagccagccttgtaagcgatgatgtgaagtgggcttcatcctgtggttctgggcagttggcaagttgttttatgcctggaagggagatggctggatttacaatgtagagagcaaactccagtggctatctgaagtgtggatttgaagggctaaaactggaggttggaagcccatttaaagagctcttgcagccataatacaagagacaatgaagatctggactaggacagcagcagcaggaatggtgatgtattaaagaaatactatagagccaaaactgactgaacttgattattgattaaatataggtattggtagaagacaagtgttaagaataactgtcagcgctcttgtttgggtaactgatggttaaggagtcaggtgagaaatagactttcagaggaggtagagggtttggaggtacagtgttttgttcttgtttttgagacagagtctcactctattacccaggctggagtgcaatggcatgatctcggctcactgcaacctccacctcccgggttcaagcaattattgtgcctcagcctactgaatagctgggattatggatgtgagccaccatgcccagctaatttttgtatttttagtaaagacagggtttcaccatgttgtccaggctggtcttgaactcctgatctcaggtgatccacccacctcagcctcccaaggtgctgggattacaggtatgagcccctgcgctcagccttgaggggctgtgttctgtttgggacatgcttaggggcctgtggaactggaaggaggggatgttagcagacagtgagaggaggctgaagtttggggagaggttcaggctaatgttgtagatttggggatgatcagggctgaggtggtagctgtatgaaatggataaatgcagcactgagaagaaaggggaaatgccatgagagaaagaaggaaaagatgaagttaatgaggaaaagagggagagtgtgtcgtgtcagatgccaagagggtaacgagtttcatgaataaggatatgaaccaactgttaaatatggcagagaagtcttaatggaagtggaaaaggccctttggtttggtaaaatacagcagctcatgaggaccccaggaggagttttccattatgggtacaaaagccagattagaggattgtgagacaaaaggggtggagacaatgaatgtagacgattgttttgagaaatctgaatgagtaagggaggagaaaatgtgcagcacagctggagaaggaacaggatcacaggaagttgctttattttcttcttcttcttcttcttctttttttcactcgtaagaataggaggtgactgggtgcactgggtcatgcccgtaatcccagctttttgggaggctaagataggcagattgcttgagcccatgagttcgagaacagcctaggcaacataggaaaaccccatctctacaaaaaataaaaaagttagctgggcatggtggcatgcacctgtagtcccggctactccgggggctgatgtgggaacatcatttgatcctgggaggcagaggttgcagtaaactgtgatcataccactgcactccaggttgggtgacagagtaagatcctgtctcaaaaaataaaaaactaaaaagaataggagactcttagctgggcatggtggttcacactgtagtggtggccacctgggaggctgagatgggagggaaaattttttgaggtcaggaggttgaagctgcagtgagctatgatcacatcactgcaccccaacctaggcgaccgatagatatgtgttttgaaaacataacgctcagagcaggttgaaaccctgtctcttaaaacaataattgaaaaaaaaaaggagacacttaagcaagtttgcaggcagcaggtaaagcactagtggagagggaagttggatccacaggagagggaaaggaaaactgctggaggtaggaggggtaggcctggggtgagataaagggcctggaagagggaagcaaggatgggtgaggtgtagaatccttactcctgaagcccttcactgctgatacttctgctatccttggcatgtgacaattcctcaagctgaggtcaatgccactgtgtcaattgcatagcaattctctttcttggggattcctataaaaactccctcataacaattccccaagtctctagtcttaccttgacgcccctcagtcttacacaattccttgctattttgactagtttgaggttacccatcatgaactccttcgacatctctcctatcttgatttatatactcttcttggtctcattttttcctgcaatattaaaaattctactgatctttcaaggtccaactcaattgatatcccttatctatgtctcactttcatcttacatatacatttttaaattacttgatgtcttttatgttatcttataagctaatttaaatacttcttaaaacaaggaagggattcaatcaacctatcaatcgtcatgataccctttcctatctcatcttcttttcatcttcttcaactttttgactcatttttatatcattcctctatgaaactattaaaccccttaagggcaagtaaatgttttttgcacctgctctagtatgacaatacattatacataatacctacctactacaattaataaattgtaagctcctggaggacaagaatttaggagttagctagctagatagagatgaatacacatgcagagatatatttacattctctcaagtataccaatttaatctaatacttactatatacttgctagcaattagagatatataaagataaataaaacaaaacacagtctctgtcttccaagggtgccaatccagtgtggcaatcagagaatgagagggcttgaatgacatgctgataaaattggactgtattctgctaggtttcttgcagaacttagggcagaggatattaatagatatgtgttttgaaaagataatgctcagagaaggatgaaggatgaatttgaaaagaatgagattgagggtaggcagatctatgagggggcttttgcaatagtgtagatgacagataataaagatcaagtgagggcaagttggttacagatgagatattgagtgtatatgcgtgtatgtgtatgttgggggagtgaggttgtggtgcacaagaataagtgtccagaagttatttgctaatcttactttttaaaagacattaaatggtaaatagtagtaataactatagcttattacatatcgtgtaacacattcctctagactggccttaggcaatattgagatctgttccatttcaccacttaggatcctctaggcccgattttggcactttattctatatgatcggctatttgttcttctcttattacttcaggtctcaagttttgatcatcctatgagcccatatatccttcagagcaagacaatgtgaataggcatcgttgcacttggtagagggttaggcaaatagtggatgccaaataaatccttgtggaattgaatggtattacctggagttccctgaaggttgtacatcctcttactccttggcctttggaacgtccttctctatacctggaattcttcctctctctctttacctcctctgactactgtctctttacctcactttgaccttcctagttctgtttatcacttcctctaagagttgttgcttgatgcccctgcactgggttagcagattttgctaagtggtccacagaatcacctacttatgtgtttctctgccagctctataaagacagaccagactaccttgcggtaatttgttcagtattttatccccaggttgagcacagcacctggcatacagtagacattcagtaaatatttgttaaatgaacatggttttgtggggttttatttgtaaatctgaacattttgaaatttgaatcttcaaatagctggacataaagtgctagatccatccagacgaaagaaataatgggagaccatctagaaaagtattttgttctttatgctattaaattcagtagaaattagttattatattttttgaggactgttatgcaattaacactctggacaacatgaagacagttcagatttcacctttctatcctgccccccaaggacatgcaaaatatctgcttgggtacccgttttttcatgtgtacacactagcatcttcagttgataagttcctgtggggcaggaacagtaaacttctcagaattagaaagcaaaagtgacagcaaaaacacgacaacatcagaaagccagattctatgtcagaaagtcttaggagttgtagctttagtgttctgcagacaacccaatgtcacaggaaatactaattcccttgctctggggcatttattaaaaacaaaattttttgggaggccgaggcgggcggatcacaaggtcaggagattgagaccatcctggctaatatggtgaaaccccatctctactaaaaaatacaaaaaattagccaggcgttgtggcgggtgcctgtagtcccagctactcggtaggctgaggcaggagaatagcgtgaactcgggaggcagggcttgcagtgagccgagatcatgccattgcactccagcctgggcaacaaagtgagactctgtctcaaaaaaaaaaaaaaaaaaaaactaaaactaaaacaaaattttacttcctactgcctggtaccatattatgcagtagagacagaggggttaaggaaatcaggcatagtccttgttctcatgtagtttgtagttaaggagtgagagaactggcagtgacctgattttgaagaggctgattcaggtcaagacccaattttgaagctggtctccaacaagaagagtggtttctaggaatatagctctgcacaagcaaatacatatcccttagacagtctgtgacatggagtgaaaaaccctccctgacagatcctttactagggatctctgcaagggctcagatctctacttcaatagaaatgctcattggtactatctgaggacgatttttccaagaggcacaaggagatcaattactactggcagcctaatttgcaagataaagaaatttcccattattctagtatcttcgcaaccacagtctacttcagcatcatcagccgacatcatggcatagtggaaaaaaatttggaatagctaaaaagtcacagattagaagttctcatagctgagatgctgctatgtgcttcttgttaaaatccagggttaggacaagggtcagaggattcttgtccttctacacttgagtggcctacagccatgtattcttctaaatcatgttttgaatttcgtcttgaaagataatgttttaagagtgctaagcttatatactcatacaacagaaataatatgtgtgataaagttgggcaagaagtgcttttaaagttgtcggtttctaaaggtgtctttttttaaatgggtacttaatagttatacctatttatgggatatatgtgatatcttgatacaagcatacaaagtgtaatgatcaaatcagtatccatcatctcaagcatttatcatttctttgtgtaaggaacactccaattctactcttttcatcattttggaatacacaagaaattgttaatcatagttgccttattgtgcttcaaaaaagttgtcttttaggttgtcttaaaatttggttacgaattgataacactagtcagaatcatgatttatattctgtagatcatttttttccatttagctttcagttataatacctcacagaataataaagcttgataggttaagtgtcttggtcctgactatcttgagaataatggttggagcaagaactatggtccagacgtctgctctagctgcaatgtttcccctccctactccattacaccacaatgatggatgaatgacggatgctgcagcagaagtaattacagtaaactcaagatataaaaacaattaatatagtgaaaatatataaattaataataaatataaaatacatgcatctttaatattaagatgtaatataatttataaattaatatagcaaatacagtaatatctaatggacagtgaccccatcaccccacttttacacgtgcctctaagagccatttcttatttttgaaggggagcagctacaccctcactctttgggttgcggtgccgtgtagaagtgatgagaatgggaaactgatacactcctgcacagagaagccaatctgaatgccagatgattaagtagaaacctccaccatgctgcctcagacttacaaatgaagtgcaaattaaaatgttagatagacatactcaacagcctgtaacatcacaaggactgtctttggggtatccatttctataaaaagaaaatctggcattcctttttggaacattaggccaaagtagaggataatgagaacagaaatgccttatgcagtcttaataatctttctactcagaggattcagtggaaactagtaactaaaaaagattagccttgcatcaagaccgagctatccagaaatcgcccggcctgggatgcagattcagtcacttaagtgagttgtaacacaggctcacttgtaggtttgccacaattttcttgcaattcagttccttcctctgtcaggctgcaataatgagatgaattcctgcaagaagtactcccagaaagacacagggaggtctgagtagataactaacacagatatctagagaacagaagtgctagacgaagagagaaataaacacacacaataattaaaacaaagatttttttaaaccatagcgacattacacttatctcaatctttaaaatccaggatatctatatctttgtgtatttctcactgaaactttccctgggcctcccaggaagaacataaagaataaagaataggttcattttcttacagattaagagatgtgaggctcaaatgaccttatcctggtaacatagctacattactgcaagagcagcatctttaatccctatgattcctactccagtcactctttaccagtgaaccatcaaagtaggtgatgatgctgaaagaggtacagaagattcagcttgtgaagataagccgaatgacagaaaatgcactttgtgcaaacctccatgcagtgatcacaatgcattttagccagtggttcagttctctctctgtccaactagactatgtaccttgaggatagaaaccatctgtccacctaatgtccccagtagtcagcacagtaactaacacatagtagtcaattaatatttgaagaacgtataaatgaatgaatgaaagcatgaatggatctggaaaagttgccatcaggaattggggccctgaagaaagaatggggttcataaataacattcagcaatcatagtcactgaattgggtactaatattagtgaaaataatagagacagtaaaaccaattataaatagataaagaaggtagtgcttgttctgttttgtttcataaaagattgacaattttatttatgaacacaggatttgagctaaaaagagaacagataagaaggtaggtgactaaagaaatggttgccgagaaaaagtatgaaacagagtttagaacagagaagaggatacagagataattgtaaaggtgtttgacagaaaaagggaaaaggagaaaagaaaaagctttcagtaggacactttatgggcataatagggttcttctttagggcatttcggaagttgagagagcaaagatgagaactcgagagacatggaatggacaaaagagaaagggaggtgagatacatggtactgatcactcacagggaatgaggaagggaagtaaatggcctcaaagaagtcatagctgtcatcgagcagcaaatgccttctgtcatgcaggtggaattaaagcttaaatgtgaactgatggtccatcttcagcttctttctcttctcgctctgatacctgccctcaaggttgctccctggctggtcagggaactcacactgagctgtagaatgttcccaggctctggacctttctgtactgttattcaaccatcagcacttgctagcttctgtcctattctctcaggatgcctgtttttattaaatgacaaaggaagttaattggttcatcaagtagagcaattcctattgtgggcttagctggctactagttaccttgcctattacatataacagcagtgaaataaacataaaggaatgaatgggtgggctttcattacgtgccaggccctgagctagatgcagcagagtatggcagaacaggacatgggctttggagacagacacacccaagacagaggtctggtccataatttcctagctataagcttgaggaagttatctcctagggttcttggattcttcatctgtaagatatgaagaataatttcttcaccctcaatttcctcctctatgaaatggagataatgttgcctacttcgcagggttcaaaatacatataagtgataataatgttatttactatttattcatttatccccactttaaaaaggaaaagctgaggcacagagaagtaaggtgtgactaaggtcacctagctgggaaattctagagctggcatttaaatctagcatttgtctttatgcacttacccaacatactatgtcatcttaaccaatacactaaagcatcattagatgtttccatctacagcctcttacagtggggaaacagtttgatattcaccaatctcatttaaccctcacagcacctctgtgcagtactaacatcttgctttaagatgaggaaaggaaagctcagagaaggtaaccgtggccaaaactcaacataggcccagagaagggaacaccagccaaaactcaaagagctaattagtgacagaacttgaaattagatgtagggtttatgaccacaaatataaatataagaaagagagccaactctgggcccagagtagatgcccacatctttactagttatctaggtggtatttctacattgcttttaaagttctctgatagcaaagctgaaacctggctaggtgttgtaagatagatgagaaactgcaagtcaaggtgtgagttcaatgagtggattttaactcctaacttcaggagtactggtcaattatcctttactgagtggtgctatcagcccacggtaaaataaattagatttttaagaaggtgcagaattgccactataaaatcagataagcctactgcagttgggaataaattctatcatagaaatacatcttgcctgatatcaaaggaagccaagaaaccatgccaagagttggatgaaaactgacattttctgctgtggagacagaagtggtagcactgattggagaattatattttgaagagttctaaaatatttatcatcattctaggtcatttattcatttacccttttaatgctcatttcttttgtgccactaggtcgagcttaaaagcaaagaatgaaaattcactgtgtttttatatattaatatgaagcaggaagtttctctattgcttggtttgaaaaataaaagcgtttctgagaaatattagaacactaaatgttctttcagaaacatggcttttgtcattaataaggatgctgggtgtatctaagcgtgttatgaatttgtacttttttttgtttgataacttcctgtaacttgaagtatttcaagaagggaaaaagctgataaaaactactaaaattgccattgcttcactgtattgattgccccattatgtttctttctagacttgactcaggcatctccttctccaggatgccttttctgctctccattctaattaagatggccttcctctgtgctccaggagcatttacacaaaccactatccatcactgcccttatcacactgcatcgaagctatctgcccgcacatctgtgccccctggaaggcaatcaggacaataaccatggcttatattccacctggtgtcctcagcacctggcatggagccagaactcagcaaatttttaccaaagaacaatgaattttaaaacctgactatagaatggcagaatgctccttctgcctccacgaaatttactttcaagttgaacaattttattaaaaattccattttctaatggtatcagagacctgcaaagctaaagaaaaagcaagtcttatttccaggtcagaacttatttcccaggtcctcactatttggcttatataatattaaaaggtatttttaagagtataatttctatttctcaggcttgaaggatacttttgttagtgtcctcatagctttctattttggctttgcatccagagaaatgaaagaggcttgactcagctgccgcttaatactgcacaagcctgagagagaagactattatataagctaatgtgtattttaaggtgtttttttttttcatagccaatacctaaatgccaccttccaacctcatgaaagtgctgaaccccagtgtgtgggaaagcgaggtcccctacacggctctgtattccttataagtataaaaaataaaagcagttgattaagggttagcaattttcttttctttctttacacgtacttgtaattcatttaatgcaggaagtgggctgagttttcttgttctttccaattcaactctcagggagctttcttgccagcctgctatggttaccatggcaacaaggcgatggtggcagtaatatgatctcatatgccttgtgtcaatagcatcagatcatcacgcttgaggataattttgacaataagcttcagatatagattcaggatatattaccatttgattgatttaccagaaatactgagcaattacagccttaaacttctaataaaagcatgttcacaaaggttagcgtttttccctagatgacatattatatggcattctgaaatttgtaaattgctttcatatatctgcttcaattctcattaggcaggacagatataatcatccccattttatagaagaggaagtaaaggcccgtgcaatgtgctgtgtaaggtggcaaaagcaactccacagtgaagctgaaacttcaacttgaggcttctggcatcagaatcacactttcctcatgcctgtgttaagaattcatgggtattatcaaaatgttcttagatgcataggttagaccctggaatgtctgaattaaaataatgtaaatgtatctgtgataaataactactagtttgagaatattagtattttatatttgggtgatgcttcatacattttatatctcccattacaccttcctttcctaaggcttttctgatactagatgcacaaatagatgcttatctctttctcccactgatcaacatcttgtcttttttgttgttgttgttattagtgacatttatttttccattgtgagttccttgaaagtagggatcatgttattcattcttggaaggtccctgatcctggcacagtatgtatggatctgttatgtatcaggtactgtacataatatgtaccaggtacataacagatacaccataaatgcttgttgcttgttaaactgaactcatctgacacccacaaaccccatgaggtaagtacagctggcattatgatccactattttaataaagtggaaatagaggtcatggatatatcatgggcaatttaattctttccactcccagccatgtgctctttccatgtcgtcctgtttgctttattctttcattgtttctctttcattcattaattcatcaaacatttattagttgctctttctatatcaagcattgctacagataatgggttacaaagataaataagacacaatcctcagcaccaaagggctcacagataatgcagataattttctgcctaggcaagtagtaaaataaaaccttatatggaacttcgagtatgcattatattatttcccaactttattggctctttaaaatgtatcttgagaatatgtttcaagtccctctttaatgcagtgttttagaactggataagccttgagccattgccaatatagggtgatactaattctgcatcttcgttttttttcttgggcataaaatcagcatttccaacatcccacagaatccctaaacttaacgtgtcctcaatgaaactcagtatctgacctgaacgaatgggaagtggcagaaagaggcagatggtcagggtgagatgccagactctgccgtttgatatgacttagggtcagttacaccatctaggggtttcttcattagtatctggcacgaaacacagtgttcaaaatacttcttaaatgtattaattaatgaatgagttgtcaaagaggatgaaaaatgatgacataaaatagggatacctgaagcagtgttagcattagcaggtactcaataaacatcttttaaagagtggactaaatatatacgattcaattccccttcctgaaacatattaaattgccaagacaaaacttctaagttatctttatgtctctttccacatcatagagtcaggtttatttcacctctgcaatgtcttggacttgtgcctttctcttcatccaatagcatgatttgatccaacccccaccctttcactagtagactctcagagaaggcccttgactgaacttcctctctttccagggtctcccattccaccttactggtgaaactcttatttttaaaggataactaggagtgtataactcttctggccagagattttgtattgatttgtatattctaattaagaaactttttagaatggtaatcaagatcctctaaaaggtgatctttagttatacctatagtcattcctttccatatactctaggttttagcttcccctacacacacttttggacttttaagctttcttcctgtattcctagttagtggagtaataacagctttgtaatacttttgcacaacactttgcaatttgtaaggaactcatatatgtttataatgaaactttgtgataacctcagagtaggtggatatgatcattttcatttcaccaattaggaaattgaaaatcagagagttaaatcatacagattctcataacctttatgagaattctattggaaaatatttgtgtctatgatgattgtttaaccatggaatacttgaatcaaactctttaaattaacaactgtgacttcaaaatgctaacgattgacatttgttcagctcgttagcccagaggctaatcatgatgcttttcttctgcatagcaaaagaaactatcaacagagtaaatagacaactacagaatggaagaaaatatttgcaaactatgcatctgacagaagtctaatatacagcatctataaagaatttaaacagggtgggcatggtggctcatgcctgtaatctgagcactttgggaggcggaggctggtgcatcacttgaggtcagaagtttgagaccagcttggccaacatattgaagccccatctctactaaaaatacaaaaattagctgggcgtggtggcatgggcctgcaatcccagctactcaggaggctgaggcagaagaattgcttgaacctgggagatggaggttgcagtgagccgagaccgtaccactgtactccagccttggtgacagagcgagactctgtctcaaaaaaaaaaagaacttaaattcacaagaaataaacaaataactccattaaaaagtggcaaaggatataaaccgatacttttctaaagaagacatacatggagccaagaatcatatgaaaaaaagctcattatcactgatcattagagaaaatgcaaatcaaaaccacaataagataccatctcacaccaatcaaaatggctattattaaaaagtaaaaaaataacagacgctggtgaggttgcagagaaaaggcagcacttacacacgatgggatcataaatttgttcaaccattgtggaaagcagtacggtaattccttaaagagctaaaagcagaactaccatttgactcagcaatcctgttactgggtatatacccagaggaatataaatcatcctcccataaagacacatgcatgcgatgtttactgcagcagtattcacaatagcaaaaacagaatcaacttaaatgcccatcaatgacagatggaatgaagaaaatgtggtaaatttacaccatggaataccatgcagccacaaaaaagaacaagatcatgtcttttgtgggaacatgatggagctggaggccattatccttagcaaactaatgcaggaacagaaaaccaaataccacatgttctcatttgtaagtgggagctaaattatgagaactcatgaacacaaagaagagaataacagatacttgggcctccttgagggtgatggttgggagaagggagaagagcagaaaaaataactattgggtactaggcttagtacctgggtgacaaaataatctgtacaacaaaccctcgtgacactagtttacctatgtaacaaacctgcatatgtaccccacaacctaaaataaaagttaaaaaaaaaatgatgttcttggctgggtgcagtggctcacacctgtaatcccagcactttgggaggctgaggtgggtggatcacttgaggtgaggagtttgagaccagcctgactaacatggtgaaactctgtctctacttaaaaaatacaaaattagccagctgtggtggcgcatgcctgtaatcccagctacttgggaggctgaggcaggagaatcacttgaacccaggaggcagaggttgcagtgagccgagattgcaccattgcactccagcctaggcaacaagagcgagactccgtctcaaaaaaaaaaaaaaaaaaaaaagatgctcttaagctggattgcctgtgtggaatcctggctctactatttcctagctgtgtggtcttggatagattacttaatctctctgtccttcaatttcctcatcattaaactggggataccaatagtttctattgtgtaggattgctgcaaggattagtgaattttatgtgcgtaaagtgctaggataatatctgacacatagcaagcactcctaaatgttgctacccttaaagacacaacctaagaacttctttggctagtccctggtctgagaaggaaaatcaattccttcctcattggtgctaccttgtttgggtcttctatactggggacactatagctgcctcagggtgttggctcaggatagattcagaatatctgaatctacttattgggagcagtcactgagtttctctaagcctcattcaccatctgaaaacacctggataataacagcattttacatcataggattgtggtgatcattttattaactagtacatataaggcatctagtgcttggcatggagtaactaatcagtaaaatttagtgactattactgttacataaatgttttgcccatgatattttgaccttcttgggttaggacctgtctttttcgttatctttatgcctatctttgttgcttcttcacagtagatttaaaaaaaataaacatttaaataaaaaagattttgcttatgagtgtcttggctatatgggctcttttttttgttccatatgaaatttaaagtagtttttttctaattctgtgaagaaagtcaatagtagcttaatggggatagcattgaatccataaattactttgagccatatagtcattttcactatattgattcttcctctccatgaacatggaatgcttttccatttgtttgtgtcctctctgatttccttgagcagtggtttgtagttctccttgaagaggtccttcacatcccttgtaacttatattcctagatattttattctgtttgtagcaattgtgaatgggagttcactcatgatttggctctctgtttgtctattattggtgtataggaatgcttgtgatatttgcacattgattttgtatcctgagactttgctgaagttgcttatcagtgtaaagagattttgggctgagatgatggggttttctaaatatataatcatgtcatctgcaaacagacagtttgacttcctctcttcctatctgaatacgctttatttctttgtcttgcctgattgccctggccagaacttccaacactatgttgaataggagtggtgagagagggcatccttgtcttgtgcccattttctaagggaatgcttccagtttttgcccattcagtatgatatgggctgtgggtttgtcataaatagctcttattattttgagataagttccatcaatacctagcttattgagtttttagcatgaagggctgttgaattttgttgaaggccttttctgtacctactgagataatcatatggtttttgtcattggttctgtttatgtgatggattatgtttattgatttgtgtatgttgaaccaaccttgcatcctagggaggaagctgatttgattgtggtggataagctttttgatgtgctgctggattcagtttgcctgtattttattgaggattttagcctcgatattcatcaggaatattggcctgaaattttattttcttgttgggtctctgccagattttggtatcaggatgaggctggcctcataaaatgagttagggaggagtccctctttttctattgtttgaaatagtttcagaaggaatggtaccagcttctctttgcacatctggtagaattcggctgtgaatctgtctggtcctgggcttgtgttggttgctaggctattaattactgcctcaatttcagaaattgttattggtctattcagggattcaacttcttcctggtttagtcttgggagggtttatgtgtccagggatttatccatttcttctagattttctagtttatatgcatagaggtatttatagcattttctgatggtagcttgtatttctgtgggatcagtggtgatatcccctttatcatttatttaaatacaaaagatttttcaataaaaatgattaaagtagcaggatagaacaatctttgcagagaaaatcccaaactctaagtggatggatgctgagactgtatgcaaaaacgctaaattctagaaagagttaaatttgaaaatatctattcttattacaaaatattgatctagtggttgttgggaaaatataaatgtaccatataataaattgggtttggattattaaaattctattaccttgtccacaatggaagcaagaatataaatgactttataaaactaaaaagttttaaattttcttctgtacattggcatatctcacaaaggaatggaattggttacactgcatatgagaacattttgatgcagtataatcttttattgtgcagctttatatagcaccctttcctgaaagagtgactgtacagcgcctggtgttctaaatccagtcgctaactcaaaccttttcactttcataaagaggttttgggaatgaagttaatattccatttaccaaactaaaatataatattatgtgctgcaatgctgtgagcccacccacccaccagactgcagataatcttctattcatatgctcaaatcaagtactatgcatatttctagctcactatcaaaagtaactgcacatatacacaaagaaaggatagaagaaaatgaatgagcagtcaaaaatgactgcaggcgactttaacaatacaagatcagccatttttgacaaatatttgatttgaaattcactgatcttctattaggactcaagggctggcaggagtaacgaatttcctgagcttctcttatgtatgttcagaagtattggatcagtttttggtctcggggtaacaacaatagcagcaaaacagtaacagcaaccaacatgcactgagtttacttcacaccagcactcaggcagaacttctgcttcagcagggtgaataagagcccccaaaggtatcagatcctaatccctggaacctgtaaattatgccttattaggagacaggaacttgcagttgtgattaacttaaggatcctgagatggggagattaccatggattatctggatgggccctaaatacaaacacatgtatcttataaaatagatggaaagggagctttgacagacaaaagaggaggaggcattgtgaccacagaggcagaaattggagtgatgtgggcacaaatcagggtatgctgacagccgccagatgctagaagaggtaaggaacatattaccctctagagcttctggagggaatgagcccctgctgacaccttgattttgcccaagtgatacttattttgaattcctgttctccaaaacttggagagaagataaatgttttttttagccagcaagttcatggtaatttgttacagcagccatgggaaactaaattaagcatccaaccattgaactaatatactaatatattgctgaactttggttcattccttcataagcctcccaaattcttgatttctttgttctgtgggggctgctgctggtaagagtagagctattaaagcatccttccatgtgaagcatcacctgctgacatttttgcagaatcccttccattgtcagccctacctacttacaagttgaaattgacacacaggtgcagtgagtcaaggtctgacttgaatgctttgcttttctctcagtagattttcttaaattcagcaagtcctcacttaatgtcatggataagatcttggagattgcaactgtaattgaaactatgtataaagaaaccaatttgaccacagtcaaatcaatataaacaagagttcagttcctatggtatatttctggtcaaagaaagtaatcaccaaacttctaaataaagaagcaaatacttctaatattaaacatcaaaataaatgggagctatacatacatttaagaaatattaatgaaaaggaagatgatgatttacccaattattccagttcaaggtcgcctgtcccggcaactcagggcaccaggtgggaacgcaccctggacgggacaccctcccatcgcagggcatactcacacccacattcgcactcactcagactgggaccatgtagacttgccaattcacctagcattaagcacatccttgggccgtggaaggaaaccggagtgcctggagaaaacccatgcagtcatggggagaacaagcaaactccacgcagacagtgacccgggctgggagtcaattttttttcttatcaacatcataaggaaacagcattacaggaaatggtgtaacttgaggacttgctctatagaactacacatgccattatttcagtatgtttcttttcttgtttgatctcattcatttgcacacttgaatccaccaataattaaaaacatctgtgaatataatcaatacataagtaatgaatttattgtttctttgggccagaaaactgttaagaacttgttatatgcaaggcattggtttagaaaccagatattcaatgataaattcttgacctcacttaaattcttattgagatgaaaagaaatattatcaagtcacaaacagtacaaagctgggtgtgaaaatgccataaggagaagatggagacaacgctgacattcagatttctggcttaaatgactgaaaaaatagtgatgccatttactgacatgggaactgcaggagaagcagcagatttgggaagagcagtggatttgaggtccctggggggcatccacgtggaaaaacaggcctgatgttaaggagagagaacttagaggttttgaaattatctgggcattggtgataattaaaatcctaggaatggaactcattgctcctggacattgcataatgggagaagaaaagagaggcttagaaaaagtacagggctagtaaagcgtatcgcatattaagagaatgatgactaacctaatttgagatttaaagggatctgataggagataaattaaaaatcagttgggtctatccaaagaggataaccctatatgccagcctccaaaatttagactttttttttttttggtcatatgtattgagtcatagttagaggttttaatttggggactagtaggattatagctatgcttataaggtaaatccagggtagtgtgtaggatggacattagagagaaaagacagaggctgaagagttgagttggaatgttaatgtgatgatctagaattagaggtaatgaaggcctgaagaactgttttaacagtgtgtgtatgtaggtatgtgtgtgtgtgtgtgtgtgtgtgtgtgtgtgtgtgtattttccccccaaatatactaaataaaattggtatcaacatttcttatcaacactatagggaaacagcattaaaggaaattatgttacttaaggtacttgaggtttgatgttcactcaaacacttttgagtatttatttctgcattaaaggtcttgcatttcatacatacaggtgaaaaaagaggaaggcaagatgtcaagagaaaaaaatgtggcatatggcctgacccagtttatttgttgagaactttgtggaagcaggatcagtaggatgcgctgcgatgtatcctggcagtggagaggaaagttaataataaccatagccacgggatgaacagtggctgctcactgagtgttgctaagggccatcaagaggtgaatgaaaagaattatccttttgttcccttcatggagatgctggcaaatgaactgaatttaactcaatgaaccacaaagcctaagggtaactgttttcctttgtggtttgcttattgaaagtcactgctgagctgatacgggtgttggggacaatgtctttgaccttggagttcttaaaaccatcctcagactcaatgaacagttggtaaggttttaggaatgtcctagcaaaagcactctggattctgcaggcaagtgggataattcctgaagtattattttaaaaattgtgtgaaacagtggaaatacactatttggagtcagatagatgagggtttgagtgccatttctatcacttggtgatcctgagaaaatcagtctccttaagccttaggcaaaatggggataatgatcgattttgtgaaaatgttaataaaataatatatggaaaaataatatatttgaatttatagatgagacttaatagataaatgtgactgccctcccatacttaaggtcactaaaaatattaattaagagtatgttgaatagaagaatttggaaaagaaaatcaagctagagagaatgggagaaatttccttaagaaacaaaacataaaattttattaggactatttgatttgcttaactgaaactctatcaaaagccattttctggtttttacatgaatcttcaaatatttctaatcagcagtttttctcttaactgccactcagcttttggttggatgatgcagagatgtaggtgtttcgagtaactaatacaattcccttctagggtatgttgcagggtgccttaacttactgtgtatgcaaggtaaataactcctaatatgagacaacaaacaaaatacatgtctaatcaattcagaaaaatgtttaggaagctccataaacatgttttcataaacgcttgctggcagccaacttgcctggctttcagagttgctataacaaccagcagtcctctcagcagccttggcactctgcattcttacatcttttaataagaaatatcattatcttgtctgggctcattagctcaattatttaaagcatggtactagtaaagccaaggtagagggttcaaaagtatgcattagcaagaaaattctatccatgtgtcctttgccaaggcgacttgttcattcattcattcatttaaaaatatttattgaatgtctgccatgtgccaggttctgttctaggagctagaaataaatcagtaaaattaaaaaaaaaatatatatatatatataaacatgtatataaaccaacaaaacaacaacaacaaaaaaccaacaaaaaaaccccaaaaaaacaaaaataattaagatgccagttttagtgatgtctatagtctggtttgaggggcaagaagggagacagatgctgactaagcaacaaattaatatacatgtagaaatacatgtagagtgagaacaatgaagacaaagcagggaaaggagacaggtgctgtgttagggtgaggagaaagtgcctcttgatatggtgacattagagcagagatttcgatgaattgaataagaaaagctgtagctaagtcatggaagaacgttttaaacagaaggttagcagggcacaagctctgaggtgagagtgtgcttggccggatcaggaccagccaggagacctgtatgactggggtattagtcagggttctctaaagggacagaactaagtggatagatgaatatatgaaggggagtttattaaggagtattgactcacaagatcataaggtgaagtcccacaataggccacctgcaagctgaggagccaggaaaccagtccaagtccccaaacctcaaaagtaggaaggtagatagtgcagctttcagtctgtggcctaaggcccgagagcccctggcaaatcactggtataagtgcaagagtccaaaagccgacgaatctggagtctgatgtatgagggcaggaagcatagtacaggagaaagatggaggccagaagactcagccagtctagtcctttcacgttcccctgcctgcttttatcccagccacactggaagttgattagatggtgcccacccagattgagggtgggtctgcctctcccaacccactgactttggcaacaccctcacaaacacacccaggaacaatacattgcatccttcaacccaatgaagttgacactcaattgtaaccatcacaattggagtggagtgctcaagggaagaacagaaggtgatgaaatcagacaggaagagatgatctgtccatgcagggtcttggaaaccactgtaagggattttagattttattctgagtgagacaggaaacgaatgcagagttctgagtaaaggggtaatataatctgacatctactttaggaaaaattgctttggatccagagactctacgtaggggctcaagaaggaaaggggatctgttaggaggttattgcaattaaacagaggagaggtgatgacagcttagagcaggtgccaaggatttaagaaataatcagactctggatgtttttagaggtagtgccagtgggatttgctgatgaaataaatgtgaagtttttctcttgagcactagaaaaatgaagacagcatttccgccctggggaagactgaaaaataaaagcatgcacaaacttatttgtgtgcatgtgtgtgtgtgtgtgtatgtgtgtaaggcagaatggagttgtggatgccttaatgttgagatttctgtgagacatctaagtggatactttcatctaggcaactaaatgtaaataataaaatctctttatagatttcagagttcaggagagatgtctgggctaaagatacaactgtaagagtcatcagtttatagatgtaatgtaagccacgggtctgaataaggacacctaggaagtaaaaatgatagagaatagaacacaaagaactgagcctttgggtaatacaatgttagacttgggaaagataggggaggggcatccaaaaggagagaatgagaaggaatggcctgcaagatggaaaaaccaagagataatgggggtattggaagaaaattaattcaatatgaaggaatttatcagttaagtcaaatgctgatgataggtcatataaaatgagggctgagaattgacaaattcggcaatgggaaagtcactgatgactgtagttagatcacttttagtagggtggaaaagagaaaaatttcctgttaaagagagaatagaggtgaagatggtgattacaagatcttttgggaggttttgctataaagtgagctgaaaaattggacagtaactgggggtaatgtagggtaaacagaattttaaaaattcaaatgaggacttattgtgacatgtttgcatgctgatgaggataatcgacagagaggggaaaattgatgatgtgcgtgagagcaggggtagtgaagcctttgagtagacaagaggggccacatagtttaaatgtgggaaatttcattcattcattccaaaaagttaagcaaacatctaccatgtgccaaatacacagctaagtactaggaacacagaaatgaataaaacatggttcccattatcaaagaagtcatttctttgggagggagaataagcattttctctaattaataattcacgttcaatgcagtgatggtaatgtcagagaaatgtacccagggctcttttctgggatcttttcattacagcatgctgaatcttgggctgccatgtcattagaagcctagattcaagaccttcatttccatcatgcattgacatgttctgggctgtactactgatgagactgatttaggcaagagttctgggcatgaattggtgctgtggctgcacagataaagtcgaggtgatagatttgagaactgtgtgctaggtaaatcagcaatcctggtgattggttgacttgaagtaaggtaaagaagagggaggctcaaggataactcctaggtttcccatatttagttttatcctggaagcgaggatgctgataaacagattcctaacaggtagcgtgggtggataagaagaagaatctgggcccttttcttaaaaaaaattaaggtctgataaatacctgatactttcaaaaatatttgaaagcagccagatatttctgtctataaaaagaaaaaaaaaatagacctgatctctataggatgtcacaaacgctcaaaaaataaaagataggaaagactaataatacaatgctagaacactttttgatactacctaagagacttaagaaaaaaaacaccaaacccccaaaacacagagttcttggtatgatgtatttgtttttccatagaatggtttgagaaattcagtgaaaattaattggaacatgtggttgtcattcacatggttccagactttatgggcttaataaaaacattatgaatagtttttggagttttgggagaagcgaacatggctggtctaggtatctgcttttaggttaatccctctacgcaggaagtttcacagtgtcatacagtgcttttcaatttttcccactcaaatgctcccactatcagagggatgagaatgagcttccctggatggcagaggaagaaagggggtagggtagtctgagggtgtaacttgaagtttcaagttgcaaacataaagtttcctttaagtctagtatttcaatttaacagtttagcaaattttctgtgcaattccgtaaaatattcatttctttcatatagaaataatagagtctccccctccccccaccttaccctgctctgaatcactgagtaaaacctatgcatggcgaagatatgtcatgttttatctcatgactttgattgcatccttgtatcctgtcacaaagcaggggaaggggaaagacacagaaccaagtttcaggaggcctggactcttctacgccagttcgacatttattttttaattttctttgcactctacttatttccaagaggagttttggagttgctgtaagacttttagaaaatataaatgatctgtgccttgatttccttatttctaaaaacaaagaagttactctacatgatctctatattcccttcttatcgattaagagtctacccacttttggtccaagcaaaatgttaacagggctagtggatggtggtaccaaatgtatactggtaaccgatcaattaacattttggaaaaaatggaatattcagctaagatttgagtcatgatggaaaccttgaatttaaaaaaaactaaccttgggagattattagaacttagaatccacatatttgacatgtgctgtaaaaagaggttatttcttgagaagtagaattgcaactttctgctgaaaaaatatcaatcctccaaggcatcctcagtaagcccacaggcaaactcccacctcagcagactgaataatttgcctataaaatatcacgttgaatttgggaggctgaatatggtgggaaaagtttcatgtaggagaggacctgccctggagatgctcgctgaggtggcaaaggcaactggactctcaaagtagtcctccgtttaacaacatccctttctcaggtacttctctcatctgcccgattacttttttttttaaagcctgacaggaatgatgcttccagattctgagatggtaacaatgatctaaatagactgtcatcatttatcagcattcacaaagagaaaacagctatgaatttccagtgggaaaaaaaactttagaatcaaaaaagcaaaaggtacataatgctgtatccagtgaaaacttataaaagtgtaatgttcgctttaaacacaatacaccaccctgagagggttgccttcagtaaggaattgttttcctctgggaaggaaatcactggcaataccaaatctataaggagtgccttagaaacttggctgcaccaagggccgtgtagttttgggaaaactcagcctgttttctttgtctctagacattttttagacttgataatccctcacatgggtgttggggtgtcttcaaggtctccaactctgtgctgtacttcgatcagcaaatgcttggggagaatttctgttttgattgcatctgccatttgcctccacaaattagacttttttaaataaaatgtaatccttttttgctgagacaaggatgaacacaatttattttgaaaagatacataaaatgtattataaaagacacaatgtgcaaaccagaaattgaaaactaaaaacgaacatcacctacacagaaaattctaagttcttaaaccagttggttgaacgaccttgggcaagttgtttaacttctttgaatcaatttcttctttatctgtaaaataaatacttataatcgtttcaagaaagtttattgactagaatccctggagccattcaaacagattcatattagccctcagcgtggctaatggcttcatctcaattctaagtgcggcacatactttcttgaaagtattgttaagtatttattttatagatgaaaactggttaaaaactacacagtagctgcatactgtaatggattctgaaaaggcctagttcaaactctgaccttctataaataacattgtggcctgccatatgaaaagacagtattgctagtgtcctgttgctgcatgggtgatgaaattaggacacggaccatgaatgagttgcctgattctgaatcagactatcaggcagtacagaaggatgccttcctctaagagttcattatttcctattagaatgctgtgtgtgctgcacatagaattgaggtggagcccttagccacactgatggctaatttgaacctgtttgaatggctccagggattccagccaataaacagaaacttgtctgttcatctgtacattcctctcaaattggttgaaataaatcctcaacacttgatgtttctgacctggttcacagatactcaggagcagcctgtggtatagcattatgagaaattttccagtctgttgagtagaagtaatccaatcctgtcactgtttgtggtagaaaggagagagaatatagagatgagatccaagaaaacaagaaaagttctgaggcctagaagaagtggaattctgtggcaaaaagtctggagaaactgaatttgagtttatggaaaaagccaaaagacagaacatcctggagaatagagccactctttgactggaagcttggaggatgattgtgagtagaatggcctatgtctaattctacatgcaggaggatggagcaggtggggccgtttcagggccaggaaagggtctcccttctactggactgggatgaaacaagagccaaggaacaaattgagttgcagtagcagatagaggaggtccagtctgagggtaaagcatggtgtccaagtagcattcagcaatggcagagcataaagtagatagttccaactggtagcccaagataaagaagcattcaaatgtatgcctgtggatggtgttcccttcccacaaggcacagaggattctgggtcaggcatcactcagagttccagagggaagggtatacatctgtcaatgcatagcaggtctcagttattcagcccaaagcaaaccattggctaaaacctttgataaaaagaaatgtgacatgtagcatggagggtggggcaagactgaggctcaggaatgggacagggcctgtcagaattaccagaagtgaggcagcaccacaagactagatcagcagcaagagttatttgaggtgcagtcacaaaaggtgagttagaatttaaatacatgccactttgggtctgatttggtcttaagtgtgtaggccaaggctcagtcttgaggtagagcatgatctcatttgtggtaagttgagagtatgctgaaattcagcatgaaaatggagatcagagatcctccaccttgctgtcagtctagacagagactgaaaaactgggttaaaactttaaagtctttatatcttggatatggagataaacaaggtaatactgcctggataaataggggaagaagctatcaaaatggtattgatctttccatttaagactatctattaccattcatctcttcaacatttgaaaagatgttcagtataacattgggattttaagtgatgattgtatcaaaaaatgataagtttaaaacattttaaacttatcagtgcacaagaacgggatgaatgcttatccagtatttctttctgtatttattatttgagtaaatcatgagtaataggttggtcccttatttaaaattttagttatggtcaattttaagaggaacacaataatctttttttttgtcttctgtacagttatatcaattttagcagtttggtgtctagttttaccaatgctattttatgatctttgccatttgccatggtacaatgtgtttaaatggcacatcaaggtatactgatggttgccatttgcttaataacttaaaagtaatccagcaatttcttccacttttatttcttaacatatgattttgttttgtgaaacatgaaagatgagtcttatatttaggaaccatttggttgggaagctgggagagtaaaatttaattgattttttttcttctgcagctcttgaagaaatagcatgtgaatccagattaggtggcatcatgtatatttttgtaaaaggaatttttacttgcttaggctgaattcatccttataagcctccctcagccatccttaattcctccctttctctcactcctgaagtcaaggattactatgttttattcctttttctgctgcaatatcccggactcttctctgtccatcactatagccacatcagctaataagctcctcttcctgtgtccttcttccctctctactcatcctctatagtgccatcaaagtcagagtattaataaacaaatcctgacatgtcagtgtgcttactccccacattttgaacggattaagttcaaatgcctcacaggatggcatttgaggtgctgatcctaatttatctttctaaccttgtttcttgcctctttcttccattcctcacatgcaaacactgaactccagtaacaccactttgtcttctcaacatactctgcactattgtgtcttcatgccccttggtacatgctatttcctctgcccagatattcttcctgggcttctgtacctgttgaccccttcaactcatcctttaaggactggttcaaagaccacttctgtgacatcatccctgattcccacagagttaaacaagacttctatgacacgccacagcatctgaaatacatctgtgctggaaacttctactatattgccttgtaatgatttgttagtgaacctctctcttccacttggtctgtagctccagaaaaccagtggctgtttgttgcctactcgtctttgctttattcttccttctgcctgtccacctgctctcccaacatccaggggccaggacagtccctggcacacaatgaacacccaacaaacacttggtttaagcaatgaattattatcttgcacgagatttcatgagtctctttagttttgctttcttaacttacttaatgcttattaagatgacttttcactttcagttcttcctgtttgattccagttcttagtcatgtcttccccttggcacaaaactgattgagcaatatatgctgaagcctcactcttcaaatttcatgacaaagtctgagggtcccaggactttggccaagcacaaatagtaagtgtctgggaggcatcaactaaattatctgccagtgaaaatgctctgtcttctttgtctcagttgtttatgcagaacaaccaaccgttcctgtaaagttatttttcctaatttttagcctaaacttttcaatagatacaggccatttctccctgtctcctcctatctcctcatcttctgagactgtaaattatcctgtaacttcatttataatgggaacatatttattttctgtgatgatggctcccctgagcctttctttttcttagctacataaagttaacttcctctgtggcaaattaaggacagattacaagcagcctgggaaccgggctccgtcaccacagggggccgcctactcagcctccttctgttcagccatgggaaagatgcagctgctaagccagccgggtgctgggctgctctccccctgcctctcctgatccctcggagggagttgagaagtccctttctccatcagtctctggttggtgtctgatgctctgttttctagcctctcttcttctgctcctcccctcccccagctgcctaccaactccttcccacccccaggccagcagtgactgcctccaagactccccctccttccagcaccgcctcatggtttccatggcaacagaaaatgttggtgggaagcaaaaatgctgaactgcaactcgtgttggggctgggaggaggaggtgaaatgtgggcctctctggaggctgtagaaaggtggggagaaagaagccaggtgagaagccctgagaagaaaggaccacgaggctcgaaaggaaggtgcattggcaagcggggatcactttgatcagaaaaatcagctaggaggaagaaataggaaagagttataaaaagtaatagagaatcctgggccgggtgaagtggctcacacctgtaatcccagaactttgggaggctgagatgagaggactgcttgagcccaggagtttgagaccggcttagacaacatagcgagaccttgtccccgccttcaaaaaaaaaaaaaagtaatgaagaatcctatatatagtggttgattgagggattacgttaggtataaaactgggaataggtgactttatattgaaggtgagtagtgaaagtcaacaaacatagtggccaaaaaaaggggggcttgagagtttaacaataatatacatacatgaaaaacaaaagtaatattaacagatctgggcttgtaaattaactattgtccttacttatcagccaagtgttacttatcttctctgagccttagtcttctttttgcttgtctattaatatagtgttatcaatatccacctcaaaaagttgttgtgaggatcaagtttaaataaagcacataaagtggccactcatatagcaggtaaggtaggaatttttcttttaaccattgtatgaggttgaggaatggtacttcaaatgggtcttggagctggaaacttaaaattcattgaaaactgtgccttgtcatatatttgatttttgtatttatttcaattttccatatctcttaagtatatggcaacatggtttttttttttcttttttttctttttctttctttctttttttttttttgagacagagtattgctctgtcgcccaggctggagtacagtggtgcgatctcggctcactgcaacctctgcctcccaggttcaagcaattcttccgcctcagcctcccaagtagctgggattacaggaacatgccaccacgcccagctatttttttgtatttttagtagagacagggtttcaccatgttggtcaggctggtctcaaactcctgacctcaggtgatccacctgcctcggcctcccaaagtgctgggattacaggcgtgagccaccatgcccagccagcatcatgtgactacgtccctaagtacatagtaccatggcaatatttagtgttaaccccttcataaaaaataagaagaaccatcctttccttttaaataacctccctgtctgtgcttttcaagaagcctgtggtgttgactcattctctctcctttacagccacaatattgttggcatcataacttctcatttcttttctctctcttcagtgaaaggggttgctgcagaaattatgttctaaacccacaatcatgtttataatggtccacgaatattttttgactgaatgtctgtgtcatcacttccttcagaagtccaaggcaagaaaagctaagaagttgtggcccaactagagatgcccataagcctatttactccgggctgtctctttgcaatcttagaagatgtcaagttactgcagaggctctacttcatgcctccttttcctgaaattgggacaataatagcaacgatgataactagcgcctgaacttgttgttccaaagtgcctgacatgaatggaatcatataaacttcaactcaacccaatggaattagcatgttgttaccgtgacggtttccacatgtggaaactgaagcacagagacattaagtaattttcttaaggtaatatacctcgtaagtttcagggctggaatttgaatctaggcagaatctacctccttaatcatctccactgtgctaccctctagggaagaaatatctggaactgtggcttgatgatattactactgctttttatagacaacgatttttttcctcacttggtatcatctaatgaataaagaaggaacgtgttactgtacttctatttcaagatgtgtactgagcccattggtttatcttttttctcctcttagatcccagtaaaaaaagctaaaaaaagaattcatgatctaacaataatgaggataattggagaaaagctatatggatctgggagatttcaataaatttccagaagtcagaaagagcgtggaaagatgatgcagtggggcagaggtagctttgggctagtgtgtttgcagagggtcctgaatcaaaaaaagagcccaagttgcccatcagaacctcggaagtttcagtctgagagaatggagatgggatggaggaggagatagagaagtgagtagaaaatgaggatgaatttaaaggtctgtgtattgaacagctgcccacctgcctgtaacacacatatccccaccccaatctctctttctctctctgtttctctctgtctctatccctttctgtctctctctctctctctcacacacacacacacacacacacacacacacacacacacacacacacacacacaccaggcatttaccctccattctcaggtcaaaaaggaagtaaggctaactctctaaagacattttaaaaagcctttctggggagagctggagcaactagtacagtggtgtttgggacaccctgatcattatagggacattctgctcaccacaacacaaaacctggaaattaaaaaaaaatgcacacagaatttccagtttgcttttccattgcctcttcctgaaatatgaacagaaaatcacaaactacagtcattagaggatagcttttagcacgagcgacaaagatcaaatgggaaataatgcacagcagaaaaactaactcaaaagacaattccaataatctcaatataaaaataactaacctctaactggtgtttctaacaggttcaaaacaatacatcagaggaaaaagaaaagggtgccaaaaaaggaatagagaaaaagagccttgagaaattgaaaatattattgccaaaattttaaaaatctatttaaacattgaaagcaatctcctagagtgtaagatgaaaatacaaagagttggtaaatgtgagcacaaggataaaagacatggaggaatgatggaagaaatccaacacctgcctaggaagatttcacaaaaaaggcaattgaaacgaagagatagatagaaatgatcaaagaaataatagaagggaatttcccaaaatgtacctttatatttaaagtgcctaccaagtgtggaacaggatgaaaaagacacccactcagtcacatcttagtgacacatcaggacactgaggataaagagaagatcctgaaacttccagagagggagaaaggtcaccgataaaagaaacaacgtcagactcctcatcaaacacatcaaacactgtaagacaagagagcattgtcttccatactcagaaaaattacatccggccttgaatgacatactaagccacgctattaatcaaccacaggggcagaatatgggcatttttagattcacaaagggttagaaattaatctttcatgtatttctcagctgtttcttttataaacagttatttgaatgtgtgctctggcaatatgaaaaatgacacagggaggaaagcatccaagaaacagtggattcaatggaggactgcaatgaagagagtcccaaaatgatgaatgtgtggcagtctcagagaacaggtccagcttcggacaggaagactaaggattaatgtgtggcagtctcagagaacagcccagcttcggacaggaagactaaggagatgggtcccaggaaaaatgtagatcagaaaaacagatagtatgatggagactatgaaaatcttaaggataaagtaaagataggaaatgcaagatgaaggaaaagtaatcagagatgacaggaaagattaaacagggttaaagattaaacaagattaaaaaaggtaagttctaggataactctaatgttcccagtaactgtgcaaatgggtgtaaccatcattatcatgggtgccctgcctctcaggacccaggtatggggttttcattcttgatacggcttcccacaccccacgagttggcatagaagcagagaaatactttcaggtcccaatgcaagcttggatgctgaggacttcagcagggaccaccatacagtacagatttccctgtgtgcctggcagcactaaggtctctagtattatggggtgacaacaggagaagccaatccagatggcaatggaatttcatgctggctttgccatggagtaaaaactaagttgacttgaaacacacacacaaaaaaattatattttgtcgcacttgaatttgtgggctaagattcagtttgcaactgtagtgtgggtagaggaattaggagagagaagagatgatagtattgacaatgtaaatcctcatctctcacatcagaatgtcagtaaataatatctaaagttgataaagccaaaattaagggcatttgcatgttatatggagataaccaccagaaggactaagcacagaaatattgaaagtatttgcttttggagagtggggctgggaacagggagaagaatgcaggaaatggtttgtattaaagttttatttgtatatttgtttgaatgcttgaaaattatatatgtattatttcattttttttaaagtgtgctcctttctgtcaattttactctccttgctacagtgtagttaagttgtccttggcatcattgttcctgtgtctatgtagaccacctgttttggaagaaggtgaggttatcaatcaaacggctaaccagtcacaggcatctactcattcacttgctaagctccttcctcattctcgtttccaagagtgctttcaaggacacaagagaagaccctatttagtgctgtcattgtcttggttgtgcggtaacaggaagcagagaagccttaatttttagcatctagacttcagctccaaatactgccattgaaatgggaagctctgattacagcttctaaagtgcactgttttctctgtgctacagaactgtcttctgaattagtatcaataaaacgctttctaacaggatctttgacaccagaagtcaccactgatgccaatgtaattaccatccctggacgctaggccttgtcaggcagcacagataatcacctacaaccaggggccaacgattacccagtcagtcaacgacattgactgctcactgggaggttctgcacgagtaagagagaggagaactgcaatgtcctttcctcaaagtacttcaaactaaacagggctgagggtgtggaggggaaggaaagcagagattcacacacatcaaaagacagaaataaacaaacctatccattctcagttacacagagagggctgtggagatctgagttggcgcagaataaaaatggacttttgcatcgcctggcccctgtttggtaaaaacctccttggttttatgtatttcctcttttcattttttttaaatggtgttatgtatttcctcttttcatttcttcccctgcccactaactgggctcaactactgaataacccctgtgtgccatgctttttctgtgcttccatactaattatatgctgttccgcttgcctgaaagctgttcctatcactcagccctttcagcttgcaaatttttctaatctatcaagaggtaaacctgacctcttctgtggagccttgcctgattcactccattttaattccaatcagttacagtgctgtgagctttgtgagaggagggacagagtatattatcatttgaaaataattaaaattgttaatagatgtaaaacacttagaatagtggtgcctgaaatgtaagcaaatgtgtttattattattattattagcatcattactatgatcaatgtttgtatttagaagccctagcataacatctggcatatgaaagtggaaactaagcaaatgtttctttgtttgaattcttggaacatttcagacaaactgagttttattgatgagaaggttgatgggttttcttggcagtggtcattattccaaggtgaaagtgaggattattgctttagctattgcaactgagaacacagaatatcttttaagaagcagaagctctaataggtgaataaatcattttggaggataggaggatattccagatgatatgaaactattgaaaacagatttgctgttggttttcagaaaatgtactagccctcaggaagatgggcttgtttggagagatacctaatgtaacacaaataacttcattttcttcagcattatctggaatagatggttaattagtctcagacagctgtttccatactcacccgcctttgctgtctgtgtgatgtgcacgtgtgtgctgtcatctgggtgagcctatctgggcacagtgacgggtcattaagctgtcttctcatatggtgcatgtatagtgtctgaagcacagtttcaggagacaggtaacacttccactcagagaggcattacatgacccctagggttgtcaatagatccgtagctcttttgctcttcaaacactacatgcattttgacatctcaccatctttgttcattgttccattcactgttatgtccttcaccccgttctttactgcttacataaatacactcaagcccacttcctccagagatttcaccatcactccagctcatagatatctcttccatctccatcatattcagcttgctttcttctttctttgtctctccctttctccctttctctctttctttttctttctctctcttttttctttttctctctgtctccctccctccctccctcaacctctctctctctatttttctgaaacagagtttcactcagtttcccaggctagaatgcagtggtgtgctcagagttcactgaagccttgaactcttgagcttaagcaatccttgcgcctcagcctctcaagctgctgggactataggccaccatgcccagctaatcaatctttctttctttctttctttttctctttgtttttctttccttccttccttctctttctttccttccttccttctctctttctttcttcttcctctctttcctttcctttcttccttctttcttctctttctctctctctccttctccccttctctcctttctctctttccctaccttccctccctccctccctccctccctccctccctccctcctttctttctttctttctttctttctttctttctttctttctttctttctttctttctttttctttctttctttctttcaagataggagtctcactgtgttgctcagactggtcttcaactcctggtctcaggcaatgctcctgattcagccttccaaactggctgggattacaggtgcaagccactgtgcgcagccagtcatagatttctaacactaatttctccaatagttacattttatattgtgaaaacacttacattgttggcttttattaacatttgaatgtgatttgctatttgctgttaagtatgctagtcttagctccctgagtagactgttggatctttaagcagatgctgtactatggctctttgtagtttctaccacatttagcacagttagatgagtatataggtacttaataggtgttcccttaggaatgaatggataaccctcctgggatccattcaaaaggattctcctgagaactccttaacaaaggcttatctactttctagtttagactgtcaacacatgctaaaggataaaagatgcagatttgaaacacatagatttacattttaaaatgctgtggcatatttgttaatatacttcacagtctgaatgcaagtttaggttagttacccttgaggacaaagctactagactctcgaggattcaaatagtctcataaaaatcatcacaatgttatcattggtagttaagggaacattttataataagtgggtgtctttgagcatgtttcctagggaaagtgctaagtgcaatctagtccatggaagtcccacagtactctgcgaacaacctgcactacttcatggccacttcacctgaatggctcagttctttgagtgtccatgtagtcaactaatcagtctgtggtgagtaagagtaaattaaggtgactaactttccaaagtcctttaaagttatttgatttaaggtcgctgagctaggtggtttatggatatttcagtattcctggaataattcatgtaagctttttccttgtatccaatatattatgagggtaagagcaatgaagccctgtgccaatttctccatttcactggctaatcagtaattctaacattgtttgccagctaaatggaacaggcactcttgtcaccatcatgattcattgcctactgaaagcacagagctggccttaatctaattcttaataaaaccttgcgaactaggtatactgtctcaatttgcacacggaaaacagatgttcacgaaggttgagggactggcccacgatctcacaccaagtaggtaaagaaccatggaagcaattctgtgccttaaagtgcaattgtctttctaattcctgtggagcatgattgtcttttccatgctgaatctaatgattacaaatatcaaatgagccctaagcatggccctgtaatcctactccattctcctagtaaactctccttcccactctctgaaacaactttttaatatcttctctatccttatatcttctacatccttacagcattattcactagaaaacagaaaccatcagaagaaacatatttccatattctcaatgcctcatataccagtcatgatggtacccactctctctgtcttccctcctgttatcacaggaatgtccccattagcaaccaactctccacttggctctggatcccaacctctctcatctttattctttccatccttctttcttttccaatatcaatacctctttttctacctaatcattcctttcagtagccaaacatgactccagtctctcctgttttaaaaaattcttccctttgccccacaagtcaccctttagctattagtgtatttccgtactcccattatcagaaaaacttcttttgacagttgtctactacttcttctatccaatgcaacatggcttccgtggctctcatttcacagaatgtgctcttgttaagttctccaggagcctctgtgttgccaaattcagtggctacttctctagtctcatttctttttttttttttcaccttcaacttttattttaagttcctagggtatatgtataggatgtgcaggtttgttacataggtaaatgtatgtcttggtggtttgctgcacagatcaaccaatcacccaggtattaagcccagcataccttaactattcttcctgatgctctccctcccccaacccccacccctgataggccccagtgtgtgttgttccccaccatgtgtccatgtgttctcatcattcagctcccatttataaatgagaacgggcagtgtttggttttctgttcctgtgttagtttgctgaggataatggcttccagctcaatccacatccctgcggagaacatgttatcataccttttcatggctgcatagtattctatggagtatatgtactacattttctttttccagtctatcattgataggcatttcggttgattctcatttgatctctcatcagcattctacctaactgataactttcccatggagcaagtttttcccatggagcaagctttcccatggagcaagcttttggtagcattctacctgataactttcccatggagcaagctttctaaacactttgagtttgaggggtcagtagaatatataggaggtagaaaactttgcttctgttgagtatcggtgaagtaacctaaggtgaaagtgcagagtgagaagagaagagactcaagggctaagcctgagggtacaggcggaagcagggagggctacaaggaagactgagaaggtaggaggagataacagagacaaggttagaagtcaaggacaaaaagagttgtcataaaaaaaaaaaagtggtcagaatcaaaggccagagaaagatcgggtaaacagggactagtaaaagtatattgtctttggcaattgagagtttattggttgccatttataaataatttcaggatgatgacagaggctgatggtattaaggcctgattgtatttttctgaagagcaaaccagcaagtgtaggcattattttgggaggcttggttatgaagggaagaagagtaagtggatagtgtctagagcagaataagaattgaggaaggttttgaaaaaaaatcaggttatatctgagtttgctcagagagggtagagaagaaggcttccctaatatcacagcattatgcaagaactaaaaatagaatctatttcttctgcctccaagataattgagataatacatgtgtaagagtttaaaaaactataaagtacaataagaatttgatatagtgttcttctttccactatattacaattaattaccaggaagtcaatggattgcatttttaactatataacacaccctttaccccactccctgcaacaagaacctcactgctatttattcagcagttcttaaatgattgatttgttgtggatgatcttttgcttgcttccttttgaaacagtgagggatttctggatgtttgccagcctgaatattcctgtttacttgtcttaggctaacagataactggatgggccatattgttatacaggcctgatgaatgccaaatgttcagctctatctctacaggattacacctttctgaaaaaagaatgtataatataacttctgtcaaataaacttgagatacatttgtttctagtcctcagatttcaagatctcccttaagactttggaaggacaagcctaattctctttgccaggcatgaaaccagacattagcttataaactcaagatgttccataattctttcaatatgaattctaattatctttgctccttctaagagaaggtaaaagtataacaatgtgaaatctaattctatggactcaaggggcagaaatcagtgacctgatattcagaggcctatattaattatccattttatttttctcacctctgtaatttgtaagtagagttgcaagggctcttgttcttcagttactattttagatcatacactctcaaatgaatggatagttctcaatgcctgcgatgcgcttgattcacacagactagcctaggttgtctgaaatgaagtcagggagacgcatgcaatgacctgtaaggtgttgtttctgtgtctttgtagcctgagttttcttgtggataaaaatctatagccttttattatgacagctcattacaccacagaaaaaactaaactgaaagatagatcatgtcttccatgatcactgctactgtttgatgtggtgtctcctgcatgaatgaaatgactgccactcagaaggtctcatggtctgagaacaaacttgacctggaaattcatctgtatttttacaaccctgtgtatggtgagaaagtttccttagtctagactgcttaatatctgtataaggccatttttttcttctctctcacctctcttgttgatactcctctgaatcatcatccacccaagatcaaggaatgctcacgctacttttgtttgtccagggctcagatctttctcagctcactcagatatgttgccccagtatctcttattgaaaacttttccctatggactcagattgacctcagtttaaatcttcagtgctttggaccatatatttagtctttctataactaagttttgcccttgtaaaactggaataatactacatactgtgtaacatttgtgagggggtaaagataatgtatgtgataatcatataacaagttcttgataaacaatagttatattattaaattggctatattttttttctttctataaaacattacttgcctaatcatcaatttccttggagtgcttctatcaggtagttatcaagtgtaaggatggaacccaaataaatatttcttgtaagtgtgatttatttaggtactggaagaggctgcaaaataaaatggaaagagtgtagggctagaaaggtgacaagttcctggttctggtgttgccagttctcatattaaatagcagtgttatctgtatatgattacccatctatgaaaaactctaagttattagaaagattgaattcatcattgatgaaagagatccttcaggcatctggaatcttatgtaaacctcacgtagactgagtttaattcaattaaataactatttattgaatgatcattatggactgtgcttggcaatgtgggggataataaacaaaggctacacatatacacacatttattgagaactgttatgagttgaattgtgtcaccccaaatttatatgttggagttctaacccctagtagatatgtggatatagatacacatcctagtagatatagtaggatgtggccttatttggagatagggtctttacagacataatcaagttaaaatgaggtcattagggtgggccctaatcaaatatgactggtgcatattcgacatgcacagaggaagagatttgaaacacaaggagaaggtgaccaaggagataggtccagaatggctccttcccttatagccctcagaggaaccaaccctgctggcactttggtctcagacttctggcctccagaactgtgagacaataaatttctcttgtttcagccacctagtttgtggttctttgttgtggcagccatagcaaactgatatgaagacctactatgtgctagtaactgggaaactaacactgaacagggcactgttatttgtttcaggggaagaagtttggaaaagaagcagatacttcagtcccatgtaataaacctgctccaagagaagtatgtacaaggtgtcatgggaggacagtgaaggacagttgagtattaccaaaggcttgtttaaggctcctcagcagggacttctaagccaggcctttgaagtaagagtgcaagaatgagtgcaagaagcaagagttctgggcagaaaacagtgtttatatgaggcagtgtatgcaaaggcacagatatctgagcaggtgtggcactgttgtagaactgtaagtaatccaacatggccagagcttaagagcagtgaaagataaggctggagaggtgagcaagttccaggtcagtagcggaaggctccctggagcaaggggagcacctagaaccttgaggtaggtcttccttgattagcaatcgcgaggacataggctatgttaggtaggagggaaactgtaaacaaaagtgaatgcgtatatttatttggcagtgagcattctggtctggttaaagcagacatcctcttgacaagcagagcaagcaagtgagaagctaagaggtaagataaagtctctcaaaggaccagaagtatgacaaacggagtgctttgagggcagggctagtatcttgtttagtgcttgcagtatagcagtggctcaagaaacaatcactgaataagtgaagggagaagtggtgaaattctgtccttttactgaattaagcagggacttttaggttacagaggtttggttttgaaatctaggctctgctggcaatttttttaaccttgttgagtttcatcctctttatttctaattgtgagtatactaatattgaccgtattggtgagaattatatgggataatttatatggaactatatagaattatgggtatactaatacttagcatgggataatttatatggaattttatagaatatatggaactatatagaattatatgaaactatatagaattatgggtatactaatgcttacagtatatggtgagaattatatgggataatttacatggaaatatatagaacttaaaaattccatttgatcaatatttattaagaagctactatatgccaagccctgtggtaggctttaggactagaaagatgaacaagacccaatctctgcctctaaggaatttactttctgttagggggatggggaagcagacatctgaatagataaaagaactgtgatgcaatagaataaggactagcttagggctaagaacagagcaccgtgggtgcacagaggagggacagttacgccagccagacggcaggatagtgttggggaatacttcctgggggaagtgatgcttaagctgattcatgaacaatgatacgcaattaggtgaagaaggaagaaaaaggaattccaaacagagggaacaacaggcttcctttgcagctgtgtttttctagttcctgtgcctgtgcaattccttgctgaaaatatactctagtcggcttggttaaagcaaaaacaccctctctagctctcgtcagactcctgaaggttggatcgtgctctgaacagcctcagctattggctggcttctctttaaactaaacaggccttcagaaacccttcatgtagccacctgcctgatctcctcactccctttctcctgctttctttcttttcttcctgtccttcctcggtatctgctttcttcctcctctcattaaacatttcctatgtctacatgtgtaaactatgggctgtgcctggagatacaggggataaaagcatacatctaactcatgaggagctcgaaactgaaagtagggtcagcgagctatggcccattgaccagatccgcctgtttttgtaaataaagttttattggaacatgcccacgcccatttatctatgtactggctatggctgctttcatgctacaatagctgtgttgtgtagttgcaatagagaccatgtggcttgcaaagcctaaaatatttaccatctggccctttacagaaaaagtttgctggcccctgttctagtgtttatatatggcagaagtggtggggatagatggacaagtaaagaggtaatgtacccctgtaagataagtttttcaaaagggtactatagaaggagagttcctaacccatacttggagattgagaaaagaactgagagctaaaaaaagtgacaagtacgcttagagctaaaggataaaaaggagttaagagggaaaggaagatcattcttggcagagacagtagcatgtgcaaagccaggcaatgaaagaaaaacatgcagttctctattgcaaaaagaggaagcggtgaaagataaggcaggaaaatcagtttgggccaggtcattaaggatcctaaatatgaaaaccatattaaggattttagaaatgccctataatctctcccataggtaactgagaacctttgaaggattttaagcagagtagtgctaaagcaaatgtgtgctctagaaagatcactctggctgtaggatagttaacatttactgggcatttattctatgccaggtctgtgctaaacgctctttgcatttggaaatatctattgagtagctggacagcactgggaaccaggtagaaagaggtgaaacatggagaacagatatggatctatgagaaccagggatctccctaagggatgaaaaggtgtagagcaccacccttatttggaggcatgaggagaagtagaagaacaggggtgattgcaaaggggagtatactgtcatggaacacaaacggggagtaaataacaaggaggagtggatagtgaaaatcagatattgtaaagagagctaagagaagaaaagtggaagaacaagcagggggcagggaactggtaagaagcagatcagagctgacttaaaagagagcaatttcagcagaaaagttgagaaacaagctggattatagggttaaggaagtggttggaagtgagaaaatggaggtcactgccactgaacacttgtttgagagatttgtctttttaaagaagagtagaaatatgactgtggctggatttcttaaaattaggctgtaattcagcagctttggtaacttttctgattcatgaggtaaatttctcatctcaaatatctggtcatttgaagtaatactggagatcaaattacgcaaatatgctgcatgactaaattaaaggcctattcatgtgagcattagttagtaatgggagttgtattatatactgcattattagaaaatggggcagcatattttaatgcttaaaaatttaatcagagcaacttccagaaggaggaaaaggctcctttttaacacaagatttgaatcatggcaatttttttttttttctgaaagccattcttctaagatggtcatccctgcacatgccctcatttctgactttctgctgcacaagcaatcagtattcgtgcaaggctaatgggatatacaagaacaattagtagctctgccagcgccaatattgtacttgcctctttaaagagctcaaaatattaaataacaattggaaagaacatttcttctagactactcattagattgattttacagatgagtaaactgaatcatagagaaacaagatagtggaaatgagaagtcttactttggttctatctcacaccactgtaaggctgtgcctattatatctgtaattaagctgttgtccagataaacaataattcctgcttggctttgacttttagataccaacagatatttaaatgccggcagttgaaaaggttatttttttttctttcaaaagtgggtttgtaactattggcttaaattattttagaaaactatagctgtactttcaacataaggccacccactcaactctgagcctagactgtttgagaaataagaaggtataggaaatttggcaggtatttttctcttgtatctttaaatctcagtaagttcacaaaattttcctaaccaatattggaacaagaaattatcacggggggaggggggtgactaatctcaccttttaaggacaattaatttttctacttcacaagtttaacttcttatttggatcacaatatgctactaagatacttaaaaggtcattttttcaggccaactgcaaatgatgttttcattatagaaaagttatgtaaaagtggaaaagagatgtaagtccattaacgtgtaaaatgcaccatagcaatgggaaaaaagttttaatgaaatacgtatgagctctatcatgcgcaaatgttttgttgaaatggatgactccaagagctctgtggttccacttcagtgtctaataggcactactcactttaaccttcagcaagccctttatgaatgctatccacccaagtgtatgaaaatgccaattcatgtagggctatcagtattattgttatttcttattctgtaaaggctgcattttgaacattttaataagggtcaaagcattccaagtcaatctagatggcaattgttagaaatgcaggaggtgctttaaaaaatgagttggtaataatttcattcttctcccattttgattagtttataaatataactgtcagctagttatcatggtgaggttattggtcagtcctcctccaagtaatataaactccttaatacagtcttcagactatgaatctaccataacattgccagtgttttgatatcatcagtatcttcatcttcctttatttcaagctatgatagattttacctcttctattatctactgtaatttgctgctgacacaccaattgctagtaaatacatatgttgagcgatggtgattatgtgaagaatgaggggcaagatccctgtggtgtagtgtgtgtgcacccatgtgtgcatgaagaaacgtgtgtatgtgtgatgtgcatgcaaataatataggtctgagggaaatactgtactccccttgaaggtaagggtcatgtcttattcactgttacatccctagtacttaacactgtctctggcacagaaatgatatctaaggagtgcttgctgcatgaatgagtgaagggtactaatggtccatgttcccattggcaaaataaggcttccagtttaaaaatgagactggaggtccacctacaacaatctgttgtgctttcagtttttacaggctgatttctacgcacacagcattatgctgggacttgtgaggaaagcaaggaaactgaatacacagaacttggacttgagaagctttcagtctaattggggagacaagatacatacaagtgaaaacttaactcctaattctagagagagaatcatggcatgccaaatgtatttttttcatgtcaaatgtaaccactgcgtgagttcaggagaaaagagcctgttctgtactgcagccattaaagaaagctacctaaactaggcaagaattgagttatacctttgaggataaaagacagcagggaaggaaaggaaatgtctgtccaggaggagcgggtagagaatacagatgagcaaagttattaagataagaatagattctttgggacttaaaatttaggaagcagtcattagactttgaaaaataaatatgatggtagagacaaatataacaaggaaataaataagcatgcacattttgtatagtaatcacttcatacctaaactccttggtgaaaaaaaatgtcgaaacttagacacattctctatgttgcaaactcaggggaagtgagtgaaatgtcagaaggcatggcagcattcccagaggttagtgagtatcaggtaggctttgccaagcaggagggaggtgatgatatttgacttctgaggggataaacaggtaaggtgggatctgggcagattttcagacaaaagattctgttgtgaaggggcttctggttttaacatagatgtgactctccttaagtcttaggtgacctgatgtacttctgaaactattcattgattgtacaaatttctatttattttacatttttaagggcacagaaggatctaaactatgtgcacaactattctacaaaccaaactgaaaatcaaaatgaaatacacaaaggaaaagttgtttgaaattttgtctttaagatacagggaaaaaatcacacatcagtaaaatcaaggataaatatcagcctgaaggaggagcaataattgacaaatatttaaaaacaattgggggccaggtgtggtggctcatgcctgtaatctcagcactttgggaggccaaggcaggcggatcatttaagatcaggagttctagaccagcctggtcgacatggtgaaaccctgtctctactaaaattacaaaaattagccgggtgtggtggtgcacacctgtaatcccagctacttgggaggctgaagcaggagaatcgcttgaactggaaagatggaggctgcagggggctgagatcacaccactgcattccagcctgggtaacaaagtgagactcccactcaaaaaaaaaaaaaaccaaaaacaaaaaacaactggggtctttcttttctaaccatatctagacattggtgaaaatagtccttattaaagataataatagctatggagataaatcatccaagtgttgcatttatgtgtgagagtatgtatgtagaacagatttagcaaataatttttaaagctttcaataaatactttaagtgacttatatggacactttaaatgcacattcattaatggattcttgattgaataaaaaattaactcctgaaaatatttcctaaataaagtacatctatgcatggatgcactatgatgtttcaaccaacattaattatacccttttgatttctactgtcttgttcaaaaacactaataagacatgcactacatcatagttaataggagtgtggtgcttgttgcttaggcaacaggaggaataaatgcaggtcagaatgtgcttcaagaaaaacaaaagctagaatatgatactgagtggagactaagcaagtctaacagatttttcaccacattaaagaaatatgtttcttagagcaagccaatcatattcatgtgtttaactaagtttgcaattacataaattagattatgtagatcaataaataatttttataaaggtagaaattaatcgcttatgatactagtagcaaataaatggtgtataacagcatgtaaagcactaattgattataccacttcatgatttgcttcattttcataattaattaactcctctaaatggcaattcaaagtttttttaaaagataattctgtctcatgaagaaagtatttgattggcccatctaagttaataatattttcttattttctagaaaattataccaaatactttgaattaaacaagtaaagaatataatctatgattagaccttggttacatcatgtatatccaggattttgccttccatataaattttgaagtgcttatacatgattcattcatgaataatttttacgatctctctttgaatgcttatttgaaacctgtttgattaacctttcagttcgaggctttcaaaaaggtattatatttgctcataagtgtttaacattcagaggaaaaataagctgaattaaagtctttcagcttggccaaatgatccaggaaatccaaagacctaacttctcatgggaccagaataaatttggacaagggtttcagggttgggaatgagaaacccttatttcaagtagacatagggagaaataattaagatattgaaatgtacagtaaacataaataataaaaaaagacttcaattctgtttgatagttcttctaattcttaatgccatctgtttagtgtcctaagtctgtcctaaatctgcccagtgttctaagactttcatagcaattgaagaactttcacttttttccatttcaatacccaaatatcttgtctatataaccagtgacagtacttgataaacacaagaaaaataacagtagctgcatatatcagtataaaaaaaccaacaaatcactcataaagcattctgtgcatgcaattacttagagctcatatatcttactatatttatgtcttttttatttttaaaaactcttgggcatacatacttttggagaaggagcagaagttgaataatgttaataatcttcaaatctataatattcaagtcaacctcagagaaaaataatctaagatagaaattaaaaaatctaatcagctgtcactattgtgttatcatttctggtactagtaagctgcaggtgtcagccctattactgtatttaggcagggctattacttatttccacaagtcatttgtgtgttacatgcctgtgttatgtaggtctctctaaacttagggatcagtgatatgtgtgatgggtacttaaaagcaaggaaaggtaatagagctgtgacgtagcttaacaaggggaactgatgagcactgggggaggtatgggaatgattagaaagctgaattgtcggtttgcacagttccccatcctccttcctcacctatatgcaaaacggtggaaagttagcacatgccaggtttagattgcatgtagaccagaattcagaagtacatgactatacttactccaccaacctttctttctaaatattgacagctaaatgaccaaagtgtttattttccacctaaagtaataaacaatacttcatcgctcttcaatcagcaagtggaagtaaacgctctccataattgaccatctgaagcagtttgctaatgaactgaaggttgtccacatgatttaaactgcttattgaacaattatcaggaaaagaaatgatcttcacaccataaacacaacaaattgtctcattaaccactaaatgctgatgctcaagtgaaataatataagaatcaagaattagctgaagagtgatataatccgagtattctaagattacaaatttatttaaaaaatcataccaagaatgacagggagaatatcaatattaatcttctttcactgcctataaatagcactctcaccagttcattcatataacacatatgtatatggatacatacagatctcattttttagcaagagtctatatgtacacagcaagttcagtcctaagggcatccaattttccaatgcagttacatatataaatctgaccagttttggtgcaaatcaggctgcctctgagccatgtaagacacataagaagcaaagacagacaaaaggcagctccgtggacacagagagcttcttaccataaactgcacattgtcaaatccattagccatcaggtggttctcgtactgaggtagcccaatgctttccaaccattgtcccactgtttggacagggcatctgggtcctgtaagaggatgaagagggaagcgtttaagcagggagtagccgtccacggggtaatagcggtagtcctgggctgagaggtggcattgccacatcatgcccctgggaaagttgctatcaaaggagcccgccagcttgacagattaatgttctcagcgagagagcaaagtcagaagtaaaacatagtttgccaggcaggctgtggagtatgacttgatcctagctccacatttcttacatattaatctttactaccgaccagtacgtcatacagcccccaaaaccaggcagcagaagaaggcatatcaagctgtcagcttgggctggtctgcgttctatgtgattgttggagtactccacaatgagcaatgcacggccggcagccagaattcttttttatcaagt

SEQ ID NO: 1719 - DNA, 410895 bp, Homo sapiens
ctgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccggtggccctctcctgtgggacttgcgttccagctgttctcagagcgggtatgatcggcctccagtagacttggagggtcacgggtgagattttgataaggttcaaatactcctcactcctgcctccggtttccaccaaagttaccattgtactactaccaacagttgtggaaatttactttggcaaaggttttgtgtttttgtttgtttgtttttccccccaaaaattatgccaattaaatccgaccttaaatgacaaggcttttctctcatgtttaaaatcccatttttttccccttgccataaataaataaaaataacttgtggcttacaggctgcttaataccacaacattttaatgagcatgtcaggtaacccacaggcttcagttctttgttgcttacaagttccatccgtaagtgtgagttgctcacttagtctggggtaacaaccgcagattcccacagagaagaatcagtgtcttaaaacaaggtaataccaacccaatggtctatgaataggttggaatggcggtactttaagtaaaagtataaagaaatggttaacattatgaggaacttccagcagtactaataatcaaccctgttgttcaggagacattcacttgctaaactttaaggctaggcatttactgccttgaaagcaaagcaaatgaagattttgaccaactgcaacattcaggctctaaaatagaaatatgaatgaattattaaataataggtaacatttactgagcacttacgattttccaggcatctgtgcattatctcatttaattcttacaactctatgaaggtttcattatattatcctcactttacagattaaaaaaaaggcttagatctgcaactggtagttttggaagaacattcttttccttaaacaggaaactctaaatgccctctgttttgtccacctttgtgccactgtctgcttctgtgagggtcaggataatagtatacctgaaaccgcccttttagcaagcggcagggccaggacataagctcagactagatgtctaattcacttgctatacatgtaacatgtaaaataaaaaagacctgcatcttgactggtgtactctttgataaatgggacctgattacttgatggaggcatgtttgactatctttgtttatgacattagcaaactttcaatgggtttggaagtgaggctatttagttctgtgtcttactctgcaatccagacacctgtgacttgaggtaaagtaagtgttttcttggtttcccaatcatgagagtgaccgaagaatgacattttccaggtcatcattctcttgtggatattgttctctgataacaatattgggcaatctcaaagagctgtcatttcttggcagtgaactacaggctatttggaaaggaggtgtaaatcactttttcatcatgtccagtcctctgcactctagagtcatttgggatgttttgtgtctgcactacctctagagaatgatggaaatctaattctctgtcagcttttctacctggctagtgaaaatgcttcttgggagagctgggaggggaagtcgctgtccatggtggtcgttactgaagccccattcagcaaaatcggttcatactctaaatactggaatcctgcttaattaaactaaggagcttctgcacagcaaaataataaacagagtaaacagacaaccttcagaatgggagaaaatatttgctagctatgcatctgaaaaaggactaatatccataatcgataaggaactccaatcaacaagaaaaaaaaaagcattaaaaaccgggcaaaggacatgagcagacatttctcaaacgaagacatacaagtggccaacaaacacatgaaaaatgctcaccattgctaatcatcagagaaatggaaattaacagcacaatgagatagtctcacaccagtcagaatgactattattaaaaagtcaaaaaataacagatgttggtgaggttgccgagaaaagggaatgcttatacacaattggtgggaatgtaaattagcacaacccctgtggaaaatagtatagggatttctcaaagagctataaacagaactaccattcgacccagcaatcccaatactgggtatctactcaaaggaaaataaattgttatatcaagaagacacctgcacttgtatgtttattgcagcactattcacagtagaaaagatatggaatcaacctgtgtctatcagtgaatgcttgggtaaagaaaatgtaaatatacaccatgggatactatgcagccataaaaaagaatgaaatcatgtcttttgcagcaacacggatggagcttgaagccattatcctaagtgaaataaaaccagaaaatcagtaccacatgttctcatttacaagtgggaactaaacaataggtacaaatggacatacagagggaaacagtagacactgggaactccaaaagcagggaggatgggaggggactgaaactgaaaaattacctattaggtataatgtccactctttgggggatgagtacactagaaacccaacctcaccgttatacaacatatccatgtaacaaacctgcatctataaaaataaaaataaaaaataaacagctgttaattttgcaaaataagtaaatattacagtctggaaattaacttcatcatggcactaatgaaatttggtgatattctccagtactgtatattaaaacataaagatcttatcagtataatctactggttggagtaaaaacattaaataattcacaggagaatgactttttactctatggcactaaaatagcccctattcattgtcaaattttagatatttttaggtaccagaacagcataaaggggataaatcatttcctgaaaccctctcaccttacagcaaagaaaatagctacctatagaggttaaccaccataattagaagcaggcgtaaaaccatgaattcttgccacagaatcacttatcatgattctgtgatgcaccaggatattgaatgtcagaatcattctttcttcagtaatttcatttttttgcttaaaaacaatttccaatttatgtcatttgaaaaacagataatatatagtctgatgtaatatgtagctcatgttcatttatgtggagtgtatctaaatcttataatattctagctgtattaagtaatattgtttcctgcaaagtgagacagtagaaaaaactcttatggtaccaatttctgaccactgtaacccagtgaaaagcaaagcattaatttcattacaggtcatcaagaatgcaaccgtcaacataaactgcttatttaagagcagccattttctatcagaaaggactaatattaaaattccccactttcctatattctccctttgtattaaaaaattatccaggggaccatgttgaatattccagtctcaaaaatccaaagatggtggtaatttttctaagagatatgtaaggccctttgtaagatttagaggaataggattttaagagtttattcatttgtttagtagtagtataatgcaatagttaatctcctgactttggaataagacctgtggattcaagtcatgggtatttaacttaattgttttgtgatcttgagtaagttacttttttgagccatgctgttctaatttgtgatatgaatgtgataataatgtaagctacttcacaagagttgtggttggaaataaattagattaccaatatgtagtacttttcactaagtaccacactacttttcactaagtaccacacattggtaatatcatttggccaggttaaagtttccatttactcaatcaaagactaatctaggtgtttctgtgaaggtattttgtagatgcaattaaagtctatagtcagttgactttaactaaaggagattatcttagataatgtcattcaactagttgaaagtccttaagagcggcttccctgaagaagaaattccacctgtggacggcagtttcggctcatccacaagagttttcacctgcccttcctaatggcttgccttagctcagtcttgtccagccagtctccacaatcatgtaagccaattccttgcaataaatctttttgtatatgtctcctactggttctgcttctctgactgaaccccaactaacacaccatgtaaagcattaactatagtatctgtgacataataaacactccaaaatattagttaattttttaaattaacccttattgaacatctctcacatttatagcactgaggtatacactctgataaaaatgtctgagagctctgaaatagaatagggatagatagatacttattgtctccaatgatagtaacctcaaccaggaagggatttaatgttttagtaaaatttccaggaaaacaagggaaaagtgccaatgggttgattattccatctggagctatgtaggggaattatgcaaattcagtatgaggccagtttcctgggttaggaagacaatgaacaaaaaggcagttactgttttctcaacagatccatatagatgtagcacctgaaactagacacaccagtttccatggatcaaccatggaattccattctgtaagaaaaatttatttacgacttggtcttaagccaattggaattatatacttgataactgccttgagattcttggaggaagaaatacgctcatatttaagagtattaaagtaaaagatctttcttatttcaatgttagcttatcttagtattctacattgttagatctttgaatttgttttgtgcatttttaagcaaggaaaaaatacttatatcactaaaaagcaggcatagcacaaacctacttaaatagaatctgcctccgtccttcagaattataatgccaaacttacaaaacttaaggctggaaatatctcagatgagtaaacaaacctcagggaggtagtctcagatataaataggattaaaaggtgatgagaaagtaagagagagtgagagcatgccttttggttttatattaaagctctgataatttagagtgaatcttagaaatagaaatgttttaaattgtgtgtttgcaggtgtgtatgtgtgtattcactaaagacagctgtcccatgatcctttatgccataatagtaattttctcaaaggcagtgctattgctgtaaaaatacttttactcattatgcaaagatttattgaatacctgtgatgtcatatgtcgagctggttgctaagggataggaaagtaaattagagatggactctaatcttgtggaactctctctgggcaactctaatttatccttatggatttcaactaacacgtgactttctctaggaaatttttgtacttcccttgctctgcactggcctaggcagttctcttttgctctcacagtaactttgcttccactaatattgcatttatcattttttttagtaattagtcaattgcttataaatctccctataagactgcatgaggtcaaggaccttgtttatgtgaacctctatttttgctcggctcttgtcctcaaataggcattaggtaaatatttacagaacgagtgaaagaaagcttgggacatgttgaattttaattgctttccaaatagaaatatgcaggaagcagaaaatatataaacctggagctgaggacagagatgggtgcaagggatacaaatttgtattagctgattcctggtagttggaaggcctgggtggattatcttcaatgaggctcacatgtagaattatgaacgagaaagtctgaggtcaggactctggacagcgtccacactctccattttatctgtgggatgaaacatggcccacatggctaggatggaaatgttttgggaaacccaaagcccaaataaatcttttcaaccatgtgagtaagtttctaatagatatttcagaactaagttactgtagagacaggagcactataaatatggatttataatcatgacattgtggaactttacctcccaatatgtagagagcagggttttcaatttcgcaaaataaataaatgaataaatgttagcatatgttaatagagggcacaaaatagaagtcagagagagaaagagtgtctgtggggactcaacagactctgtgggaatcagactctctgattttctctctcaatggaatcaaggagtcccacgagttaggcattgggaaaggctctctgggtggtgaacagacatgtgtggctattggtggtgaatgtccaccacagaagcagcgtggctcttccttatactcaaggcttttttttgccattaatgagaagtaagacacagactgactcccagcacttaccaattttattattcttattgcctcctcatactttgccatgggaaaatccctgtttggatcacaaatttaaaacaatagactgcctgttaaccatgggcatatttacagatctgactatgagctaatacaacccagagtgagcagaagggacttatactttttcctgaaggcaagcaggcttggaatccaaggggaatgaatataaacactgagacccatctgccccagtcttctgaattaaaacctagggacttcttttgttaactctgttcaaggcccaaaccacatacagctccattgagccacagctaagatttttgcttgcagcctttgcttagaactggcccctgagagtcagtttcatctgtacagcacagttggtaagtacctcatccttcccacacctttaagcaacagaacagccacagtcaacacttacagcaactttcaaggttagcaatgaaagaagaaggctgcagtaacctcatctggatgcctgttttactaagtaattatacatcccaaatttcacaggacaaccttctttaaatgaatcagatcataaaatctgatttttcacttaggaaaatatggttaaatcatattagagactcatacttggagtcttcaaggaggtagcataatatacagaaaaaaagtccatggactccgaccgtggttcaagttcagctctatcatatttactggttgtagaccctgagcaacttgcttaacctgactgcacctcagtttctgcatctgtaaaatgaggataagtgttctttaaagatgttgtttaaggattaaatataagtacactcatataaaaatctagcacaatgcctggaccacaataattattcaaccagagaatcaagttcaccctagtacaaattcataagcattcagaatcaagaagttattccagcttatcaacagaactaaataataaagctcattcccacagcaccttctagtgtgcttatcagctgtgtaagtgaggaggagcccatgaacttgggaggggacagtaactttttatattgtagactcataaaaatgattttatttttttctctacaggatttttagaggacaaaatagtctctcatttgatggtgattatgtacattattatgataattctctaggaatgcacattaaggattttgaaatatattagaaggacaaaggaagaaagaatgacataataaatattaaaacataatttggggttgggataattgaatcttaggataaaatatggctgatggccattgttttttcctgctcaacacccggtgctctatttctgttaccaatagtctgatttgttactggggacccaactctcccacacttagctatgaaatcctagataatcaaccttaaaagagctggccatggagtggacccatgagccactggccaagcagaagattccatcatgcagccacagtggtttgttcagagacggtcagaaccaagactgttggaactactgggaaaaaggggaactcttctcactggggcttctgatgatgagcttggtattaccagggtgccaggtgtaatgcctggagctgccaagggccatcttgtggagagggtctacccaagagtgaagccagcgcagagaaaagcagagcagagatatggattggagtccagtgatagtttttgaggctctggatccagtcatgcctgaaacctttggactttatctcttatatgagccaataaatttttcattttacttcagccacttggagttggatttttggcagttgtaactgtaaagtgtcctgatttcttcagcagggaacttaagtataatttatctcaacctcccctctgatgtttgaatcttctctacaacttctaatgaaagagtcactcaatcaaggcttggactcctccagtgatagggagctcattaccaactgaagaagcccatccatctttgagacttatattactgcaaaattttttcttatatcaagtgaaggtttctgaaacctttgtaattaccacttattttgtacccagtagaggccagagaccctgtgctatgttatacttaaaaatatacattgtgatttaattctcaaattaaaaatttgaaaattttatttttgaaataatttaataaattaaattaataaaaattaatatctaatgatattaaaattattttagaagctgctgcacaaatccaagtgagaaatgatgagaggctgaagcaagggctatgggggtggggataaagaagatgaggagggatccagtgatgtacagatgtagcatacaggtgactgagtggagggtgagggcaagagtgaaacaggagacttggagggcctccagaaaatagacaggtgttgaaaagcagggagaaacaacctggatgggaaagatgaaggttctgctgtttatcccaagagttaccataagtcgaaggggtcactacttccaaggacacatgatagctctacaaatttctttaaaattttaactgaatctggtttagtgttaagaaataatcatgaacagaattggatgtgcatcaaaagcaaagttttagaaagacctgcaatttttgcacagacctttaatcacatgagtgcaagtcagaataacacttttatgttcagcccttaagactggtttctcccttctctcctcctgccagtgccccagaaggcagaggagaggatccagagaactcagcacgaagatgcagcagagtttgcctgagccacaggggatgggagtctgaccgtgaggtccaggaaccaaagagaagtgcattccagtggaatatgtttctaggaatgggaaagagggagaaagggaagaaacattttatgtatacctactatgtgccaggtcctttttatgtaggattattattattatttcagtatcactttttttttttcccaaatgtaaaaactgtggaggtctgcaaagttaagtaattttccaagatcaagcagcattagaattaagtccaggatgtatgtatgcctctgagatctgtaatttcttcattatgctatgctgtctccttaaataattagcagttataagacgcaagttataaggtgacaaaatacattgacatggtatctggattaacaacaacccagaaggctagtatttctaatattgtttctattttatagatgaggaaactgagtccctaagaggttcattgactagctcaaggccacacagctagtaagtagaaccatagctggaactaaaaattcccatctccaagatctgtgtattttcccatgacactgcagctactacgctgggcaagctactatgaagctggactttgtcagaacagtgacagataacagctttgctctgaaacgttctttccttcaaaggaacgcacccaacctaatgcttgtggtggcgcctgctttcacccacattggctcacaagagaaagactccaaggaaaaaaggaatgagggtccctagagtttctgatgagggtagggcggaggtgctttcaaggatggttaaccctctctcagggctgggcgcaaaggctcctgcctgtgatcccagcactttgcggggccgaggtgggaggactgcttgagttcaggagtttgagaccatcctggacaacatagcgagaccccatatctacaaaaaatttttaaaaattagcctggcatggtggtgcacacctgtagtcccagctgtccgggagggtgaggcaagaggatcacttgcgcccaggaagttgaggctgtagtgagccaagatcgtaccattgcactccagcctgggtgacaaagcaagaacctgtctcaaaaaaagagaagaaaaagaaaaaagacatgagacgtaggagccaggcatttttcagccacaaataccaagtggataaaaaaaaataatgaaaagaatagaagaatggttagcccactctctttctagtgaaccctgggataaggtctatggtgcagtgctgtgaaaattcactcaatccacgagatctatacactttgttgggacctgggatagaatgaaccagtgttcccttagaatggaaatgactgagtagaaataatgtgggaagccacattaactctttcaggccattaggctatcatttagtaaattactacattgttctaaatgggtccctagtgggtatggagggtgagaatgttctaatttgcttttctctcctttctctcagctgctttctcctactatgatgtagaacaagaagtggtttaataactgctctattccaaatcactgaatgctcttataactactgcataaaagtgcccctgcaggtctgctatattgaaatgtgtggaatcaaatctatgcatatgatatgaggggtgggggctgcaatctggtacccacaggatctagaagtaactcgaggaaccaggatatccctgattttaaattctaggttaatggagggcgtgtgaccgagagccccatgttcctggggagggaacagatgccactggaagctgcagggcaggagtttctccacctaaaagggaggatccacaactctgatctgaggaggagtccgtgtctctgccttggcatgtatattacaagagaaaatcataggaagggcaaggatgttccctgacgactggcttccctctgtcactcaggatgcatggccactgttggttgaaggaactatcatttttctccctgattgaaaaacaaaagaatcaaagctctcccttgtgcttacaaatctggggatattaattaaatacctagtagagatgctggggcctaatattattgcataatggtgattacagcaacaatgcattatatagcattaaatgtttttgaagcactttcatattcatttgttttttaaataatttttgtttttatttttttccagtttcattgaggtagaattaacaagcaaaacatgtacacctgtatgtattcaaggtgtatgatatgttgttttgacatacatacacactgtgaaatgatttccacaatcaagctaatgaacatatcatcccctcacatagttactctgtgtgtgtgtgtgtgtgtgtgtgtgtgtgtgtgtgtgtgtgtatgtatggtgagaatacttaagatctgctctcttagtgaatttcaagtatacaatacattattattaactatagttaccatgctatattattaggtctcctgaacttattcataactgcaagtttgtaccctttgtccaacatctcccctttgcatattcgttgttggtcagggctatcttgatggacatatgaagatgggctccatgcttggtttaattctctgcagtcacagtcttgtaattccaaataactttaacttggaattagtattttgtaagcaaggtctgatgggactgtggagcatgtgctgggcttggaacctcagcttgatgccgtcctgccttcctgggatgggtttttggctgccagctccctgtctcatgctggtcctgctcagggccctgcccactccacccccttaccccacaaccactgctgcaatcaggtggcactggcagggggaggaaagagaccagcttggattcagtccttgaccactctcttcccccaatggtggtggtgggggagtctcgacatggacggtcatccacctcatggctttttggggtaggcaaggcagcagccatccttgtccctaattgcaacatcatggcttgtttggtgggtgatatagtttggctatgtccccacccaaatctcatcttgaattgtagctcccataattcccacgtgctgtgggagggacccagtgggagataattgaaccaaactgtttaccccatactgttcttatgctagtgaatcagtctcacaagatctgatgattttataaggggtttccacttttgcttggctctcattctttctcttgcctgctgccatgtaagatgtgcctttgcttctcctttgccttctgccaggattgtgaggcctccccagccacatggaactgtgagtccattaaacctctttttctttataaattacccggtctcaggtatgtctttattagcagtgtgagaacagactgatacagggggcaatacagttggtgactctgcatgagtctttcacccatctctgactcaagtaccaagcacatcctggcctagggattgtaatctgttgggtagtcacctgtctgctgtgggttgggagtggtgggcctgtaggaaagggagattgacttccctgtccctggccaggcctcacagtttcattttataccaggccttgcaaaatatatagccagacctgtagttgacatttattgtaatatccatgcaagctggataggacaagaatgttgctactgttatgtctgcttccattatttctactgctggggaggctaccattaccttctctgtgacttgcacttgggcaagcacttaacaatatatcatcccatttaatcttcacaaccaatatacaaggtagggtttatacactggggtggttccctaacttctctgagttttagtttcctcatctggaaaactggtatcataatgcctacttggtaaggatattgtgagaattaaataagatgacatgtatattaagagatggaggtaattttatctacctgcattcctctaattctatatttgttaggaagaaatcttttggtaagctgcttgaggagaagagtcaccatggacagactaaaataacccaataagcttgcttaacttttgcacttatgacaaggagtagtgtttgttccttgccattgttcccaagaggaaggtggcaaagaaagagttggtgagggcgaagcatttgcaggggaagagaacaggagtgacagtatgtcctttagaaagtggaaatattgaatggggttctaaacaaattgtttggttgggtttatgctataaacagcccaacctacccaccgtcatgaaatcttcagtaaaggctgtgtagctgactaacgcttttgtgtgtgattagataaatgcgggagaggggctcagtgtctgttctcaaagaggcattgaaattcacatccacgttggcacaagtgaaaacagacagcttgtgccagaagatgagtgcagagctggtgtgtggttctaatactattcttggaatgcttcctctgagtgacctccctctctgttcaggccacgcatttctggagggtataacagcagtatattgttatattgtatatatatgtatattctgtttggtttctattcttccacaggccccaccatcaggttccgcacagagtgaacactcaaatgttgagggctgataaatgtgagtagcaactactaaatgaaggagatgaatatgcttttgtatagtaacttcaacgatgctttgatatagaaattagtttacctagtgtactgatgaggtacatgaggctcagagaggctaagaaacttgcctggcgtcacacagctagtaagcagcaaaaacagacattcatgttccatacacaatgccttcctggtcagtgacactttagcagactatctagagttctggcatcgtataaaccaggcattatccacatatgtatattttaaaacctcactgaaagcagaaggataagatgaattgactttaagcattcctggggaacaaaaagtcaaaatggaaaaggagaacaggagcataagaaaaaaatatatagcataactcgttatcccttagataactgtagggtcatgctgatattagtcattgtactgtgatgacaccaaaaagggaaagtgtaccagctagccaggtagatgcaattcattgtgcaagaaaaggctgcctcaaatgtgtctaaaagcgtggttcttcattcagccaagtcaagaccaaaggagcacatgaataattggctacagctcccctttcagcaagtaccagctttctctgctgaggctgatacagctccatacctcagggggccgggaatcagctgccagcagccaatgggcttctgagcattcataagcagaccaggtgctgatccatcaggctaattagcagcctgtgggccacagttagctgggaaggtggagggttttaactcttttcctgacagactccaagcctatctgggctttttgagcaatgttctatcagtcaaaccacaaagaaaagtattagaattcaaaaggagggaagctaaaaggaaatatagttttgctttaaataagacaagggagactaacaacacaaaggaagtgaactttgactctcaaatatacatatatatagatgtatatatgtgtctgtacgcatctcagtctacgtatcttcatgttactgactgtaatgtcatcaccacagcagacattcaatacatgtttgcttttgttgaggatgatatagtgatatttaaaacagaaataataaacaagggaagaaaataggacaggattgcaagggagggggatatttagcttgttggcacctgaaatgtatttaattatcaggctcccaaaagagcagaggaaacagaattagcttcaatgaaaaatacagagaacatgctgaaagttcagaaaaaatgcaaaacttactttaattaggagatggagatggaatacatcagaaatagtgtcactgcaaattaccagacttataaaccaatatgtaaatcagcagaggaaacaatcccatgaattttagtaaatttgtagaaacttgttgtaaatagtgcatttaaaattagttttaatgtgaaatagaatcaacaatcaatgaagccaacaccatccaaatgtcttcattgacataaaaggagcattctatagtcaattggttctatatttttgactttagtgtggttttgttgatcatggatccaataatctccagtgaagcagtgccaatatatgatctagcgataggaaataacaaacaagcatcctaatccttaaagtagccaaatctgacaatcatagaaaatggcaaggcaggatactggcaaaagtcttaaaacacagaggtaacatttatggagatgtctgcacgggctctctgtcaacatatggagaattgaggaagagctacgggatttcaatgacaagcccatcaccaccatctggagataaaaattctgtggtagattttttttttaaactgtgatattttactgataaattttatattagtgacaagatcctaaccaaagtttccttggactgcttactataaaactgtgtactattgactctggggttaaaaaaatggatttatgcctcactgagaaacagctgtcattgcatttgtagaatcatagtgtcaagatgatgaaactgagctaattccagagtcttcagggacctaaagaaagcattatacagccctgaggaggtttgggtgtactggcagtaatgtcaactgtatggccctgagaaactaatctccatgttgagattatgaacacaaatctttccccaaatatttactgagtaaaaacatagtgagtggtccattagggagagcaggagcatgagttggattgtttttgttctaagaaatgaatgcactaccttggactataatcaatttggggattgtggtcttttaaacagaccatagcagatgattcagtgtcagtgggccactggattcatgccaagtgataattctccataacgcttcctacagtctggtgtgtgcaaaacaggcaaggtcacaagtctgttctacagccaccgggtgtgctggtccttttattgtcctggcaaagtaacaaccctgtgtatgcacccctacaaactatctccccatggtttggtcagagctgacccccaagctcaccctgcctaagtcatttattactagcagaggaagaaataagcatataatcatgaccttatctacttctctagcctcaaatctagtctctcctcaatcaaaccctttcctatccctcagggacaccttgactgggtgcctttgcctgtgggactctctgcccttagcatctttcaattagttctctgcctggaaggctgttcttctttcatgtgttacctcctcctgaaatggtttcttgataataacagcaaacacataggatttgcttcataccaggcgcacttctaaatgctttattaaatgtacttacttctcaccagaaccctttgaaataggtactgttatagtctctactttagatataaagaaacttaaaggcagagttgttaagaaatttactcagggtcactggtaaatggtagagctgaggttatgaaccatggcagcctggctccagagtgtctgttcttcatcacgactctgagcataatgatccctagactttgctgttagtatcctgagcactcgctaccagagaagtagctgcactgcactctagtcatgtttgtaagcttcctctctttccatgctaactccagttaatccaacaacactcagccaaagcatcaactttttcccccttaagtcttcctgatcctgctcccctaacctgtgggaggtgaatcctccactgcccacaccatgcttctctctgctagactccttatcacaccacgtgtcttgtttacctgtctgcctccctcattaatctgtgaactctgaagttttgaaggcacgaatggtctcagtaacacagtatctggcatatagaactgttgcttaataaatatttgtctgtttgatggatggagactggtgctaacaagtcttcattttgcaactctggtttctagcttttaccggcagattaagaacaaaagggattccatcacaaatcctgggagaatcatgacaaatgcttagcttcagttcagaaagaagcaagactatttatagctcagggactcaacattaaatgacccggacttaatttttccttgtgacctagatttgcacaactttagatggaaagtgcccttggagatcattttacccaggtattgcaaactggtggcctagagttgtttttatttgacatatattatttgtttctatttttattagaatacctttagacaggacatgtgctttttatttctccacattttacatcatatcctatcatacaccactttactcatttgtattatccacctgaccattcaaagcatttgaatatgaaatgtctgaattagtctaactcattttttttggtctttgtttacagtaaagctcccaagtctgtacttagggtctccaattttctcattaattcattccagtcagatgttctcccaccctctactgatgtgtagactgatttccatgtaacaatgtaccaatcatgtaccagtgatttccacctagctaaatccagttcctagcttggacctcaacccctcctccttgacattcaggaccatactctcctggttttcctcctacttctctggcctccccttctctgtcttcttgctgattcctcctcatactctcgacctctaaatgttggatcctccaaggtgcagctcgtggcctgcttctcttctggatctactctcatccccttggggatcttgtacaggctcatgagtttaaacactgcccacatgttgacacttcctcagtgtacatctccagctcacttggttgtctagtgggcctgtcaaacttaatatgtctaaaaacaaactgccaatttcttcatattttttttgttgttgttgagatggagtcttgctctgttgcccaggctggagtgcagtggtgcaatctcagctcactacaacttccacctcctgggttaaagtgattctcctgcctcagcctcccgagtagctacgatgacagacgcgtgccactaccacacccatctaatttttgtatttttagtagagacaaggttttgccatgttggccaggctggtcttgaactcttgacctcaggtgatttgcccgccttggcctcccacaaactgtcaatttctaccccaaacctgctcttcttagcagttttctttatgtcagttaggggtatatccgggccaccagttgctcaggccaaaatccatgggcttatctctcattgcttcctttctatgtgatatggtttggatatttttcctcttcaaatatcacgctgaattgtaatccccggtgttggaggtggaatctggtgggaggtgtttggatcatggcggcggatcccttatagacggcttagctctatcctcttggtgatgagtgagccatgagatctggttgattaaaagtatggtacctccccactctctcttgatcctattactatgtgacatgctggctccttgtcaccttttcagccatgattgtaagcttcctgaggcctcaggagaagcacatgccagcaccattcttcctataaagcctgctgaaccatgagccagacaaacctcttttctttataaattacccagcctcaggcatttctttatagcaacacaagaacagtctaacacactttcatatgccatatacaagtcctcagcagtcatgtctactccaatcttccagtgcctcccttgttctttaagagtaaaagccaaagaaagtccttagagtggtctctaggagccttgatattctaccttccttccttattcctatccctacctttatttctcagacccccattcccaccactatcccccttattgacctgcctccagctcactggcctcccttcactgttgagtgaacactccaggcatttttctacatcggggtgtttgcatttgctgttccttctgcctggaatacccccacccttcccttccccatccccaggtatctgcatgtatctgcatgggttgcttcctcatttccttcatgactactcaaatgaacctcctcactgaagctttccttgaccactctatttgaaatagacttccctaagccaggatgatttttcatccctcctttctgcttttctctagagcactttattaccctctaatatcctatatattttacttacctattttgtttctcttcctactagaatgtaagctaaatgagggcaggcttgtttgtcttctttgtttactgctacatcctcagcatcagaataaggctgagaacttgttatgggttgaattatgttccccccaccacccccagtaagtcccagtgaccttatttgggaacgaggtcattacagatgtaattagttaagatgaggtcacactggagcaggctggacccctaatccaatatgactagcgtccttctagaaagaatggcatgtgaagagaaggagatatccatagagggaagatgatgtgaagatgtacagggagaagatggccatctacaagccaaggagagagatctggagcagatctttcagacttgatttcagacttctaagacttctagcctccagaactgtgagacagaatttttttttagacagagtctcactctgttgcccaggcaggagtacagtggtgtgatctcagcttactgcaacctccgcctcccaggttcaagcgatcctcctgcctcagtgccctgagtagctgggactacaggcatgtatcatcacacccagctaattttttgcatatttagtagggacgggctttcaccatgctggccaggctgatctcgaactcctgatctcaagtgatccacctgccttggcctctcatagtgctgggattacaggcatgagccatcgtgcctggccaagacaatacatttctattgtttggaccaacctgggtgtgttactttatcactacagccctagcaaactaatactcaaaaaaattctcaagaaaaatgtatgggtgaataaacaagtgaattaatcctttcaatgaagaaactgaaggccagtgaagttgattaacttgccagaaacacaccatggtgaacgggcagaaccaagactcaaatccagctttcctgccgccccatctagctctcagccaccacatctggatgccacgtcagtctgtctcatgagcactaacaatggtgggctgaggttgagggggatctccggagccccttcaccatctcctaggtcttgcctatcctgccttcctgcttaacgctcccaccaccatcacataacctggatatgttgtggccagacaattattgacgtatgtttgttaagtgttctgatctcctctcagaggaaaaccctgtgtttgactcttctattattcaggaagtaataaaagttatagtcataatatataagaaaaaagaatgattcactgctgagctactgagctacagggagcaatccaaggtttagaacagacaattggctaagatcagtcacgatgatgtcacagcggaatatacaaatacctcagtgggctgatccaagagaacatcacaattaaatcagcttactgctgagcactcttccacatctgtgaagagctgctctccattctgacagccacgtttaaggaggtggtggaggcggcagtctatccaacaccctccacacaggaagaaaggattgcaaagtgctactgagtaaatgaacatcattcacatggaaatgcactggacgagatcatacatgttaagacagttaacagacaggttaggaacaatgttttcttttcagaatggaattacagtatgacattgggcatgggaaactgatgagagccatcagagatgatattcaaaatgtttaacaaaatatcgacagcataagccatcaatggccaatgcagccttatcaatgcagagtggttgaacatggtgctggtgaaactcacttggctagaatagcagagatgccattaacctctctgacccttagtttagtttcttcattgcagagtgaggcaccaccacttatttcctagtgttgttacaaaggttaagaaaaaaatctgtgccacaattcctggtacatatcagatccccaataataagagcaaacatttatgtgtctttattatatataaggtattagcaaatgctaatttacttaacccttatagcagccctagtattcaactattttttttttttttttgagacaggatctcactctgtcaccctggctggagtgcagtggcacaatcacagctcactgcagcctccacctcccgggctcaagtggtcctcctgtctcagcttcctaagtagctggtgctacagatgtataccaccatgcccagttaatttttaaatttttcgtagagacagggtctcactatgccacccaggctggtcaagaactcctgggctcaagcaattattattagcattttcccgttggagaaattgatatagagagcggttaagcaactttctcaatgtcacactgctggtgaatggcaagacagggtcttaggacccaggtagaatgaatcccaggggctccttccccaccctatgctaccctcaggaaatgtcggggcccatccctcccactttatgctccagagagccagtgtccctgcaaacctaacatctcattgcctcaaagtcccagctaaagcctagtggagaggacatcactctttggtccttcagtgccctagcccttctttctaggtttactcaatttccatttgcatgaagacagacaagaaaaacagtccaattaatacgaagcgtaagaccacaagatgagaaggcttttgctttgctttttattttgtatcagctgaagtgctgtgagtattcgggatgaaaaattatttatcccagttaatgaatctcatgataataaaaatgcctgacagctctgagattagtgagtagcccttatctggggaccacttagtgaagcaaatcctgcgtgaacaaaggacaaatgggatttgggagaatgaggaggaagggaggctaagaacgaacatgtgttttgcagctatctcatgccaggcatcacacaaggtactcaaccctcattctttcttttaattcttttgagaactcagtctttatacaaacacttatggcagtgccaggtaccataataagtgttggggttacaaaattaaataaatcatggcccctgtccttttaagtagaatggatacagaaaataagtagagaggctatttatgttcactgcaatattagtttgatatgagtatacacaggcagtggaactatgctatacaggccaagatgatacctaccatgtcaatagttcctgcataaggactatttcctgcatacgcagctgtgttctgggctgggtgatatacccctgcacctccccatggcccctcaggcccttcacggaggttagttggctagaggagtgagattctcttaggagtttacacttggaagcagaaagagaatcaggcaattggttgtgggaacagaaactgagaagatgatctaaaaggagtgatgaagtacagtagaatggggctgggtgggaccatgtgtaagcggaagctatgaatacacagaagatacaaggcacagaaaacgctgagcagaatgtgaggaagctaggtcgtagcaggaaatgaatagaagcagaggatactctaaccaacgtatgccccacaatttaatcctttccctaatgttagatcattctcattttttcctgtattacaaggaatcctatgatgaatatcattgcacatcagtatttgtagcatttctgatgagtttctctaatatattcttggattaaatggtatgcacattttaatgctcttgagacaagtatgcatctttatttccaggaagatagcactaatttcccacgcccttcagtattatatgagtgagtctactttaacacattgtctcacactgagtccttgtcacttaaacagggaacggtagtaactacctttttaattgtttaattatttaatttttaattgtttgcatatttttcatatgttatgggacatttgtatttcctcttttgtgactccagcttgtttatgtctttttgtccatttgcctataaggccatttataatgctcttattgatgtatgagaaatcaataaaatttatataacaagaccaatactcactgacatatttagcaaacacttacccataattagttgttttccttttcatttttatttgaggcacggaagttttatatttttcaatatattgatattttcctttgtaatttgtttcaaagggtttctttttgcggaaaaaaatctttttctgttttctagatcaggaaaatacttggctctgtttcttttcctacttttggaaaatgtttttgcttttatatttaacttttctgttcacttacaatttattttggtgtatttgaacctttatgaaggaagattttgtactaaattaaaaaagaggatggtgtgatcctgtttcagaaaaatctaatctgtgttaatgtttgttccccagcagaatcaaccatggattacttccaatgaccagtgcaatgacttgagcacacacagacccatttaaatacataatgagggagaacatatgatcaagggcggagatgccatcatttgtgctctgtatacaacctacttttattaaatggaaattatggtcactgaataactcaatctacctaaactcttacaaggaatcagaagccctcagttcttaagctgggtctgtactgatttacaatgggacacaaacacactgtacctccttaaccctaacacccactttccaattgcctgtctttcaaaactatctaattagatttctttaaaaagaacatttttgtcatttgtgaggaatttttcttttcttttttagtttgctcttactgaaaaaccaaggcaacttcaactttatcttttcatagggtccctttccaagtgttatgactgaatggaagctgtgtggttggtgaagtacttcggctatatttccaaaaatatgcaattgttaggggctgcaatgcaacagccagttccagagactagcaaaaggcagggggatactctcaagagtgactacactcgagactttccatttcagcaacttcaggaattggggaaaactcactaattcaacactgagttctctgaaagtgatggtgtattagtttgctaggtctaccataacaaagtacagcaaattgggtggcttaaacaacagacatttgttttctcagaactctggaggccagatattcaagatggcagcactggggagaaaatctagcttctggtggtttgcaggcaatctttgacatttctttgcttgcagaaacatgaccacaatatctgtcttactcttcacatggcattctctgtaaagccacactatttgcttagattgtttgaagaaggcactttcagatgtgttccagaggctgggcaccttgatctggatcaaacgctgccaattgttggttgaaggtgagtgtagaaatgtatctacttccaaagccaaaatattactgtattagtccgttttcatgctgctgataaagacatacctgagactgggtaatttatacaggaaaaagggtttaacggacttacagttccacgtggctgggaggcctcacaatcatggtggaaggaaaggaggagcaagtcacatcttatgtggatagcagcaggcaaagagagagcttgtgcaggaaaactccaccttataaagccatcagatcttgtgacatttattcactatcacgagaacagcacgggaaggacctgcacccatgattcagttacctcccacctggtccctcccacaacatgtgggaattcaagatgagatttgggtggggacacagccaaaccatatcaattactaagtacacagaaaaatttataagtcttggtccatgtacctcatcaacttcttctagcaagaagcagctggctgacttgcaatgaaatctccttagagttttatctttaaatcattgatctcaatggatatcttatacctgaaaatttgctgttttactaagggtgaagtaaattaaattccacaagagttagaaaataatttaatcagctggcaaaagctaaggatgaaagcaagttaatacaaatttcaattttcaaacaagattcaatacatgtatataatttatttggctagattcaatacatgtatataatttatttggctattacagggagagaaaacataattactaggtcttattaaaagtatgtctttcttcttttccctgtcatcctttcttccctttcttctttcatttttaaattcccttcccctcttcctcattccttcctcctttcttttcttcttccctcccttgatgttttccatttactcagaaaacatttagggagcaattaccacaagttagagtatacaccatatgccaaggatgcacccaaaatgtacaggtgataaagcagcagttcctgccctcagcaagttcatagcctaatagaatctgagttatgtaagggtgaaggccctacagtacattctctataatattgtagtaagaggaataatctcagatctcatgcatgcattccatgatttttctctttacttttgccactgtttttctacctgatattaatcttaatactataatcttatactactccttcaagcagctccgtgtgttttctataggcccaccaattattgccatgttctaataaggttttaaagaaaatatgtgaccctttagaacatcaccccacttccatgcctgtcttccatcctctgtataaagagcagagggtgtgaagaatggactagaagggttcctgggtggctcattgttgtgatctgtttgcctgctttggcatgctttgattataataaatatcttctctgaggggagcattttgaggaaagtgattgtaaaagaagatggaaatccatctataaagatggtaaccacaggaactaatttgaagaggtttttcatatttattaatagcatagaattgtccttccagaaagcataaagttctaaatttgaacaaagtccacagtctgaaccaaaattctgtacctttcagaatggatcataaaagaaaaaaagtctacagcacaaaaatagtttcctcctataacctcaaacaaatgtgagggcgatctgcccttgcaattttcattacttcaagataacaacaaggaaactatgattcagttagttctttcctttcacacattcagagttactctgcaattgctgagtgctagtgtatctatcctcaagtggcatttctgtttgagaactgtatttttcattatttagagttttctgtaatttttactggtaatattaatatttaacaatatcatacccccagaggtatctttgtgcaactttagaatatacgtactttgtttctttttatgactctaaccttttattctttcattcctctagtactctgaatataagagagtctacacgctttttagtgaggattttttgatccctgcttcataagtgtcactcattgtaggctttcctttgacaacaaaaattcctgctctctttacgttgactctaattacttcaccagaaaaggtaaacctgtcattgtgtaagaaaaggaattaagttaatgtaactgtttcttaaggtcttattattattttatttttatttttttgagacagagtcttgctgtgtggcccaggctggagtgcagtggcacaatctcggctcactgcaacctctgcctcctgggttcaagcgattctcctgcctcagcctcccgagtagctggaattataggcatgcaccaccacgcctggctaatttttctatttttagtagagatggggtttcaccatgttggccaggctggtcttgaactcccgacctcaggcgatccacccacctcagcctcccaaagtgctgggatgacaggcatgagccactgtgcctggctcttaagggcttaatgtgaatgttgcatacacatgtaatttctgattcatttgtggacctttgcgtaaaaataaaattttcttagaaattcatagaaaaacatggcagttcttaccatgcatcacagtcaatttcctgagggttctgttctttggagtctggggaggggaggtgctgtggtttggatgtgtttttttcccaccaaagcccatggtgaaattcaatcctcagtgtggcagtgtggggagatagggcctagtgagaggtgtctgggtcatagaggtatatccctcatgaatagattaatgccttcctgctagggtgagtgagttctagctctcaggggaatgggttagttcccttgaaagtgagaatgggttgttaaaaggagtctggcttccttggttttgctcttttgcttcctttctcagcctgtgatctctgcacactttggctctctgtcactttccaccatcagtagaagcagcatgaggccctcaccagacacagctgcctaagcttggggtttccaggatcatgagccaaataaacctcttttctttataaactacccgtctcaggtagtctgttctagcaacataaaacagactaagacagaggtcttcaataccaaaagatagtctacttgatgtgtgaagggaggctttggtttgcctgctataaaataattttagttgatgaacccgaagttccctgaaggtttagtttctggtgactttcattctgcaattcttgcacaaatggaaaaaaatccatcctagttgaatggagtacctacactacaaatgtagagtgaatctgtagaaaccactttttagataactgataaaccagctagttgctaatcacttcattgctgcttcccaccaccagtcaatgtttaaaaaaaataaagaattctccacctaactttgacaactggggaaaggtaggactttgtttcagcatcaaaaggaagtagagccacgtagaattatcatttagttccctcagtcatagccatttctcatttttcatcttccctacttttctcagggccatttattgtcctctaatgcctcccttctcttcattcttttttgctcttaatatctctggagggacaccaaagaagtgatttctttctgcattcattaaaaataggtttatgttttgccttcctgttcaattcccacttgggctgtaagcaagtaactaaagcaagggaagggttgggcatgtgggcgccagacttagatgcctctatttatgcctagattcttcctatttctcccattcttccctcaggataggagaaaaaggaggtggcagaggtctgattaaagcagggatgagcaactgagccaccactgcagtgctgagattgggtgaagcccccagcttcacagaaaggcctgcaacatcattgcaagattaaatgtgccaatattcttgctaagttactactttttgcacattaccagagaatagacttcccgggcctaaaggaatggcaatgttttcattgtcatttatttctctgttcagtaaggtagatagtacaggttttaagagtcttcttttttttcctcatgagactctatttcttttcccctctattttcttctatgctaaatggctgtatctactcttgaaaatacattctaactctaagtgtcctttgtggatttgactttaggaaaccaaagtagcttcccccaagccaccctctgtctctcttttttgtttttttgcccattggtcgattttaccttctttttgtataccatcaacccaaagacacagcatactagggacgtaagtgtggaactgataccgttagttttatttcggggtgatgcaatccctctgctaattcttagatggtcttatggtgtcagaagaaaatttccttctgtcagaaagccttaagtacgtttggaaaataattcagaatcaaggctgtcttcttctgttttttaatcaattcactaaatagtcttcatcatacagagaaattattccttctactccactccaaactaagacattattttgaaatagattatcaaataatagtgcagactaatttccatagctcaatgagtagaaggcaaagtacattatttgctaatgcaaatgctgagccttctccaaaaaatttaatattcaaagtccagacgggataaggagacaaaaaaagattgcttaacaattttccaaaccaaagtgacctataacacacaaaatatggttctattatgtgcaactgatattttctttgttgagaataatgagctacagcagaatggcataatgtagaactccacagctgataagctttctgcataagaacaggaagaggacatttcttaaagagttctgtgttcattgcttaccttgaggaggcagtgaatggaattactgttaatagtaacaatatgaagctaattggtttaaaatgaagcagcaggaaatgctgatgatgagactggggtatatgaaggaagaatgaaaaatctatactccggctacacaaaaatgatgcttaaaatgtaacttaatcttgatattttattcataaatgacaaatctgctcactacactgattccctaggtgactcatcaaatcccatctctaggtttatgaatctcaaaattttgtagctagttctgactgttttcactggcaaaatttgtcaaaatcaacttcttaagaatttggaaattaacccaaagtttgcaataatacaaaaagcatttacttttttaaaaaatggctgaatcccagtaaaaacagtgagctttgtggcattttaacttgcacttataaccatctgcctctccacagcttcacagtatccttgaaaatcaacagctttgcagccatgatagctatgaaaactagcagcctagcagccactggaggggacaggtcaggtatgaagctcccccaaaattcccattcccagagaatggtcactatttaacctgtctgaaagttccttaagaaagctccattcttatagtttgtctttatttgccttgacttaaagctcatttggtgggaatagccctgaccccagctaattttttgaaataatcagcaaaaaagctttcagaatagtgacactaattgaaactaaaaaaagaatgaccaaaaatttcacaggaaagactggataatgagatgtgtttaggggggtttgaaaagctctgatagatttctggtaatctagaaggccatgcacatatacagggctgtgcacgttcccagaaaagacctgagaagcccctattctctcatctctagttgactttgaggttctgtgcaagctggatgtgaaggctaaggcagagttgtaaactgcctggtagagcattgaagacacaccttaatacacacacatagtcctttggcagtggctgggagacttactggctcaaggcatttaaggaaatctgttcaatcattaggtaattggtaagctaactgagcacagacttctgtggatgcagtgagagataacacagaatttacagaattagtccaggaaagtcactaaacaaacagcagctgcaataataaagggcatcaacaacagaccttagagaggagggaggaatatgaattccagaattgccacactatattccttaaaatgtatagcattcaacaagaagttaggagacatgtaaataaaaagcaaagtatggcccatacacaggaaaaaaggaagtcaatagaaactgtccatggatgttggacttcctagacgaagactttaaaccatctatcataaatatgttcaagttactataggagacatgtctaaagaattaagggaaagtatgaaaataacgttttggcaaatagagaatgttaacaaaggatataaatgatttaaacgtacaaaatcggaattgtggagctgagcagtgtaatagctgtgataaaaatatagtggggctcaacagaagaaagaataagcaaacttgaataaaggccaattgagatgaataaatagaagaacagaggaaaaaagaatgaagaaaaacagtatcaaagacctgtgcagtgccatcaaatgtaacaacacatgcatagtgagagtcccagacagataagagaaaaaaaggggatgaagaatatttgaagaaataacagctgggaactctccaaacttgatgaaaactattaatccacacatgcaagaagcccagtgaactccaagtagggcaaactcaaagagatccttactttactacattacagccaaactttctacagctaaagacaaaaagagaatcttgagaatgccaagagaaaagtgactcattgagttcaagggatcctaaataacattaacagccagcttctcaacaaaaaccatgaaatccagaagaaaaaggaatgacctattcaaagtgccaagaattttacatccagcaaaaccaccagttaaaaacaaaggagaaattaagacatcctcagataaactgagggaatcttatcactagcagatcttgctccacagcagatagtaaggggaaaccttccgggggaaatgaaaggatgctggacagtaactcaaatccacatgaaaaaataaagagtaccagtacaagtaactgcatttgtaaatataaaagacaatataaacacatttttgcttgtaactctttctaatttaaaagacgaatgcaaagcaatgatgacaagctgtttgataggcttataatttataaatatatacttttttaattgaaatttttttcttttatcatccagcccaaaatgtcataaagatataatttctatgacaataataacacaaaggaggagaaagggaatgaagctatattgaagcagttttacatataattgacggtaaattggtattaatccaaactagattattttaagttaagatgttaattgtaatctctaaggcaaccactaagaaaataaagatatagtaagagaaacaagaaaattaaaatagtatactagaaaatttatatgttaaaaagaagaaaacctcaagtcaataactaaaacacacctcaaggcactggaaaaagaagagcaaattaaacctaaagcaagaagaagaaaggaaataataaaaataagagtagaaataaataatttagagaacagtaaaacaatagaggaaatcaacaaaaccaaaagtgtattctttgaaaagatcaagaaagttaaattaacaaatctttacctagactgaccaagaaaaaaaaaagactcgaatttcaaattattaaaattaggactgtaagaggggatattggctgtgcagaaataaaacaaaagattataagggaatgccatgaacaactgtatgccaacaaattaaataatcttggtgaactgaacaaatacctaaaaaaccacaaactgttgaaaccaactcaagaaaaattcaaaaatcttaatataacaaggatagagattggattcgtaattaaaaaaaaaaaacttcccacaaagagaagtctaggccaaaatggccttattaatgaattctaccaaatacttaaagaattaacaccaatttcataagttctaccaaaaaatagaaagggaaggaatacttctgaactgattctatgaggccagtatacactgacaccataatgagacaatgacatcacaagaaaataaaattaaagatcaatatatcttatgcatattgatgcaacaattctctagaaaatatcagcaatctgaatccagaaacatattaaaagaattataaccatgatcaagtgggatgcatcctgggaatgcaagatgtatttaacatacaaacataaatcataaatcaatgcaatactttaaattaatatataaaatgacaaaaattacgttatgagcacaatagatgcaggaatctcctttaacacagcccaatactcttttatgataaaaatcattcaacaaaccaggaaaaaaacacagaacttcctcaatctgataaagcccagccatatatagaacccatacggctaaaataatacttaatggcgaaagaccagatgtttttccctttcccaagacaaagctagctactctggtcacttctattcaatatagtattgggggtgctagccaggctaattaggcaagaaaaagaaatcaatgcatctagcttgaaaaggaagaagtgaaactatctctatttgcagattacgtgatcgttatatagaaaaccctaatacacacacacacacacacacacacacacacaagttcagcgaggtttcctgatacaagatcaatacacaagcattagttgtatttctgtgtattgacaatgaacaatttggaagtgaaattaagacaaaaattccttatagaatagtatcaaaaagaaaatgcctagtaatagatttaaaaaagaaatgcaatactttcacactgaaaactaaaatatcattgcaagaagttaaagaaaaactaaataaatggaaagaaaactcatgttcatgtatcagaagactgaatacgtgaagatggtaatactcccccaaattgatctacagattcaatccaatacctattagtatctcagctgccttatttgtagaaattaatgagctgatcctaaaattcacatggaaatgcaaaggacccaagatagccacaaaaatcttgagtaagaagaacaaagatgaagaactcatacttcctgatttcaaaacctgatacaaagctacagttatcaagacagtataaagcataagaacagtattggtataaggagagacatataaatcaatgaaaataatttatattttcagtagttcagtagcaggcttttacagggttaactgattttcagtaagagtgccaaggtaatccaatggaggggaaacaggctcttcaacaaaagttctggacaactgaatatccacattcaaaggaatgaagttgtaccagctcacatgattcacaaaaattaactcaaaatgaatcataggcctaaatgaaaatgctaacactataaaactcagaagaaaacatagaagaaaatcttcagaatcttggatcaggcatgacttcttagcaatgacactgaaagcacaagtgacacaagaaaaaatatataatggacatcatcaaaattaaaaactttttgtgattcaaatgatattatgaagaaagtaaaaatacaatccacaaaaatggagaaaatatttgtaaatcaaatatctgataagggttttctattccaggtatataattaattgttatagctcaacaataaaagataagtgacccaattttaaaatgggcaaaagatttgaatagacatttctccaaaaaatatatgcaaataaccaataaacacatgaaaagttacacagcctcactagtcatcagggaaatgcaaataaaaaccacaatgaaataccacttcattcctactaagatggctaaaataaaaaagaccataacaaatgctgacaaaggtgtggagaaattgtaactctcatatgttactggtgggattataaaatggtgaagccactttggaaaacagttcagcagttcctcagaaagttaaatttagagttaccatatgatccagcaattccactcctaggtatacacccaagagaattgaaaacatatgtggatacaaaatttgtacataaatgtttctagcagcattattaaaaatagccccaaagtctaaacaattcaaatgtccatgaaatgatgaatggatacataactgtggtgtatctatatgatgggataaaaatttgtcaataaaatgaagtacttatacatactataatctggtgaaccttgaaaacactctaattgaaaaaaactaatgaaaaaaagaccacatattgtacgattctgtttatatgaaatgtccagtgtaggggctggggaaagtgggggcggggtagtgactgctcatggttatggggtgtcttttggggatggtgagaatgttctaaagttaagacagttgtgatggtcacacaactctgtgagtacacgaaaaccactgaattgtacatattaaaggagcaaatttaatggtgtgtgaattatatctcaataaaaaataatgtggtgtaaatctggccactcatggttttcacctcccttttttttttctcccctattgggacaattcataagttaccatgctgctggcagctctggcagaaaatgatggtgacagaaaatgacatttcaggaatggcttttaaggcacgaggagcaatagcctgaggataatcagagttgttaggctactctcctgtcctggaaagtgaaatcaacctgattctgtccatcatggacactggtgacttgagttgttgacgaatgttctgtaaagtttaatatcccctgctacactttaaatacagagcccaatccaccatatctttcaaactcaggctatttcaaacataactgaagtagaacttcaaattagagaaacttgaggccttctgatcactggccagaggggaaaaattgttttttatgacctgaaaatgtatttagtatgaaaagaaaatgacttcttaagatgagaataagaaaggggggaaataaccaaatttgaagttctaggtaaatacaataaggcaactgaatagacactcctttctcctgttttctattaggattataattggggattctatctccatccaatagtgtttctgtacacttcaaaggtaggctaactatttaaaccagagacagaacactctgtattactctttttatattgatgtcctgttacaaccatgttttgtttcgttttgtactagagaaaaaagaggactcaaacttatgttgtcaaatatttcctagacacttttgtgtgtgacaggaaggaaacttgttaatactgctgtctcaggtaatactgcttttttagttaatactgcccttcatccctgtgtttaccccctcgagcttatcctccctgttatctgattggtttgtcaacattctgaaccaaaactctattttttaatggaaagcctaaggaggcactttttcctgaaagagattggtgtccctgattatacttactcagagccttctctggattactgggaaggaacacacctgtgcatttgatcttaacaagctctaaatctatattgtgttgctcaggggttgcctgacagagctcagtcccatggtggaagaaacctaccaacctcggtcttctcagctttcaaaggcgacacctgcctctggcctctctctgcattctccccattatgatgtggttctccagaccagggaagagaccagggggaaacacaaactaacacaacaagctccttctggttctgtgtgtagctctttgcaatttccctgctctggtaggcagcactttccaatcagccctgcagctccacctctgagaattcttcatgaggaacaagctttctttagtcatagtcacttgtataagaagagatgttttccttcatgagttgtttgaaatgcagtacagtcattccttgtgttctgaaaagctcccactaaatgacatcatttaattccaggatgctcagaatacttaataatacctttggttttgtctttgcaaaacaagttttgtgtttgtggaagggaacaaatctgaggagtggcaagcggcgaagaccaaaagcttatctgtgtggaattgctgctgtagacaagaacaatataatcctccctgttctgtacctactaaatcttacaaagggttagaaaaatagtatttcatctgtctttgggtttttgataataccaaataacatcaaatggaagcagtctcatggtttcttcattgctaaactaattgttattacatacttgttcctgtgtgatgttaatatatattcctggaaccagaaaggtctacatggtcaaataaatttgaaacttgcattaaataagaataaattgatttttttctccttcagggtttcacagaatctttaataccaatgtgcttttttgaacctcttaatgcagctctggtaggctgactttctgtgtgtgtgtgattattttatttactgccaatctccttaaagttagtttttatttaaaaattatttgtataaacacctgaactatttgactttttaaaaattccattctattgtgttaatagcacttaacatgcgatctacctctgtaaaccatttttaagtgtacattattgttgactgtaaggacaatgtggcacagtagacctctagagcatatttatcttggttgactgaaactttatggctgttgattagtaactccccatttagtaactccccaattagtaactctccctagccctggaaaccacaattgcactctttgattctatgagtttgacaatttcagatgccttacacaagtagcattatgtagtatttgaatttctgcgactaacttacttcacttagcataatgtcctcaaggttcatctgtgttgtcacatattgcagagtttccttctttttaaagactgaatagtattccattgtatgcaactgtgtatgcatacaccacattttctttatccatttgttgatggatatttaggttgtttctatgtcttggctgtagtgaatagtgctgctgtgaatataagagtgctaatacctctttagatcctgatttcaattttggtgggggatacatacccagaagtagattgctggatcatgtggtagacatatgtttgttttttttaagaaacatctatactgcttttcatagcagctataccattttacgttcccaccaacagtgtggagcggtctcaatttctccacattcttgacatttggtgtctttttaaaaaaataatactcatccagacaggtgtgaggtgagctctcatagtgcttttgacttgcatttccctgatgattagtgatgttaagtattttctcatatacctgttgtcatttgcatgtcctctttggagaaatgtctattcaagtccttagcccattaaaaaaaatcatgttactaggtttttttttcttttttactattgagtagtaggaattccttgtataggttggagaataacctcgtatctgatatatggtttgcaaatattttgtcccattcagtaagttgccttttcactcagttgactgtttcttttgttgtgcatgaactttttattttgatgtagtcctacttatttttgtttttgttccctgtgccttttgtgtcatacccatgaaatcatggccaagacgactgtcaagtggtttttcatgtatgttttcttctagcaggtttacagtttcagatctttaaatgtaaaataataatattgaattgatattttgtgtatgccataaggtccagtttcattgctttgtatgtcacgtccagtcttctcaatatcattagttgaagagactatcctttcccattgtgtattcttggcaccgtttgtgatgaccagttgaccatgtatgcatggatttatttctgggctctttattctactccattagcctatatgtctgtttttatgccagtatcatactattttgattactgtggctttgtgatatatattgaaataggacgtgtgaggcctccagcttttttcttctttctcaagattgacttggctaagaattttagcattttgtctatttatgtaaaaaaatgccattggaactttgataggaattgcatttaatctgtagattgctttgagaagtatgaacatttcaataatattagatcttccaatccatgaacatttgatatcttttcatttgtttgtttcttgttttatttctttttactatattttgtagttttcagtctgctttcaacttcttagttgagtttatttctagatattttatttttttggtgctattgtaaatagaatttttttcctaatttcttttttcagatagttcattgttagtgtatagaaatgcaagtaatttttatatattgatttggtatatatcaatatataccaactttactgaattcattttttagttctaacagttttttttttaaatggagtctttagaattttcaaatatataagatcatgtcatctgcaaacaatgtggacaatttcacttcttccctttcaatttgggcaccttttttccttgcctgactgctctggctaggactcccagtattatgttgaatagaagtggcaagagtaggcattcttgccttgactctaatcttagagaaaaagctttcagtttttcatcattgagtatgaggttggctgtgggctaaccacatatcaccttaattataatatgttgaagtaatttctttctgtttctagtttgttgagagtttttatcatcaaaggatgttgaattttgtcaattgatttttcagcatctattgagatgatcatatgatttttatcttttattctgttaatgtggtgctaattggttttcatatgttgagccatccttgaattctacagataaatcccacttggttatggtgtatgatccttttaatgtgcttttagattcagctttctagtattttgttgaagatttctgcatctatgcatatcagggatattggctgcagttttctcttcttttgtactgtctttatctggctttggtatcagcataatgctggtctcataaaataaatttggaagtattcttccctcttcaagtttttggaagagtttgagaaagatcgacattaattcttctttaaatgtttggtagaactcaccagtgaagtaatttggtcctgggattttctttgttaggaggtttttatgatagacagtcttgcctcttgaatgaatatttatatctcaagaagctagtgttctgtgaaagtttgtgaatgaagttttagattcataccctttaacctaatgtaataattaagagaggagactttggacaaaaagtactggattctatttgtgggtctctaccaattaacttcatttacagaattagcatagtaatacttgctacaaatcgagttgtgaaaatttagtgaaatatatgtatactaacaaacaaaaccccaggcacttaggtggccttaaataaatggtagctattattgtgtataaaaaagttagtttagtcaacaccttttccagcaagaagcaagaatttctttcgtttataataataatttaataaaatttcctaaaatgccttctgcatgatgcaagaatgatgaaattatatgcaatgttcagttcgattttagtggttagcacaatttatggtattttattgtttaggaaagggagagtaaagaacatctattgagagtttatttagtactcataccagtcttagggagtaaaaattatctaaccccacttcactgatgagtatgcttcagtaaattgctaaagttcatggaaagcatattctgtggcaatgttagaattcaaacccaggtcccctgactccaaagccaatgctgtctccatactgccataccaccttctttaaaaatgaacaatttggctgggcatggtggctcatgcctgtaatcccagcactttgggaggctgaggtgggcggatcatgaggtcaagaggttgagaccatcctggccaacatgttgaaacctcgtctctactaaaaatacaaaaattagccgggcgtggtggcagttgcctgtaatcccagctactcaggaggctgaggcaggagaatcacttgaacccaggaggtggaggttgcagtgagccgagatcgcaccactgcactccagcctggtgacagagtgagactctgttaaaaaaaaaaagaacaattaattcttgtgtgtacataatagctctctgttaactaaggctattctattcttcacttgtttcaaataaatatctcccctactagatctcaatacagtggtcttaagtcaatttaatcccagtaatgttttatagtcattttctcagaatttctctcatgttcaggtaaggattacataattgaacacaaaattttatcttgtctaagtacttctgacttcacagggaattgtgataaggagtataactcagtggagatgatgtgggatggtaggtggaatgctggccgtggccttagtagtgatcttagtccttcccctgctttaagtccctgtgtgacccagtgagttactctgtatctttaggtcttagttttcttactatttgctctatctacctcatgggagttctgtgaagagtagattaactcacttttccaactctccctatctgtagttgtctcaaagtggagaatgcatactccagggatgagcaggatggttcattcgggtagaggaggatgacatcaaggaacacttataggtgctttaaaatttgttcttttaaaatttacgtttttagcatatgttttataatgtatggacatagcattacatttatgaaaaccataaacacacaaacatatattggagatatgtgctttttttttaattaataggggtaggtgataaaaatgtcgagggcctggtggcctccaggataaagtccaaattctttagtatggcatttatgtcctctggggaccctccagcttcatttcctcccccattgcttctccttctacttaatgaactgaacatactagtatgttttgtagcttcactgtctttgcttatactactctttttgccagagactcctgaaacctctctcagcctcccaccttccacttgaaagactaatttctcaagactcagcaaaggagttatctcctgaataagccctttcctgaacctctcaggtatgccagatcactccttccttgggcttccactgtactgtacacatgccacctataagctgtgtggaagtgtgcttgtttgatttcatttactagtctgtagatctctgtattactctacactgctataaagatactatctgaaactgggcaatttatgaagaaaagaggtttaattgactcaaagttccaaatggctggggaggcctcaggaaatgtacaatcacagtggaaggtgaagcagaagcaaggcacatcttacatggcagcaggagagagagagagagagagtgcaggggaaactggcaattttaaaccatcagatcttgtgagaactccctcacgatcactagagcagcatgggggaaactgcccccatgatccaatcacctcttaccaggttcttcccttgacatgtggggattacaattcgagatgatatttgggtggggacacagagccaaaccatattaagggcaactgccatggcttcttaaatcttttttgttttagaacctaaaatggtccctggtatgtatttcataaatattgattagctatgcaaatagcaaataagctctgagagtactatagcatgttaaaatctccaggcaaatgttaatagttattattattaacctacgttaaattctcataggtttcagtggaatatctttattaaaaatcttaatcaagtgacgtgagcaaaacaatcctaattgacacctgtagacactggttttcaaccccgggagctttcaaaaatatcagtgcccaggctctgctcataggggttttgattcaattggtatgggatatgggtcaggcatctgtggtttttaaaagctccccagatgattttcatgtgcaggcagggctgagaaccattgtttcaaatgtcatggataggaaaagaaaggtgcttgggaaaacctaaggcagagtgctcttcctgaaaatgcaactgcagttgtgaaagcttctgtctttgtaaggttaagatgtgtccttgggggaagacacacacacacaaattgcagttatttattgagaccagactactaagtcacttcgatgaaaacttgagagcttaagactcgccagcatgggctaagaatagatcacattgcagaaaccagaacagtttcttggaaggaatggctgaagacattgacaaaggctgagcagaggatgaaattgggaagtcacccatcaactatgggggttgggcaacgtgaaaatgtgcttaccatttgcaatgaaatggaaaaggccttggtgagaaggcagtggagattaatgataataagtcatgttgagttttaacaagataacatacaggataacaaaaaggcaaaagtttattaagtcagatcctgattttgcaactaacaccttttttcctccctctctttttcaccttgagactgttacagatagctgagtaaggtgccaaattagactcgaactgcatctcagggtgaaaactgtgagtgagcatcagctaatgttatcctaaagtgtatggaattacaagtttctatgaagatgtttttgagaaaccttattaggattagtgcgtatgttgtcaacattggattttctagagaatcagagtgaatatagctggtacataagcattgttaatttgcatcatggatatcaaagccttcttgatagaaattacctatttgcactgcatactaatttgggcattgctgctctggaattgataaaagtttagcctataaattggctgaagttccttttgtgctaagaaagaatttgctaagcagatgcataatgtgccattggccattgcggttaatttttttaagagaataaatatttccaagcacttaagtgccatgtgttacaaatcacaccactcagggactagttgaggcttcttttttccttgaagtcgggcaggcaggacctctagtggcaatggctagttagcagttagatttagtgctaatgttttagaaagtacaaactgcacttcttttaaattctggttgatagacttcaggttgatattccccccaataatttaagctttgcacattctaattccctggtgttcaaattgtcacaagttcttgctgtgtacatatttcttggaggaacacttttaaagaaaatggcttcaaagattcccaggcaaagtggacacctggacctgtaaaaggaacgctgcccctaagatgtggaaagaggccaacaaatgttttaattggttcttgacttcagtactactgactttttctcacatggcacactgatgcccctaaatacccatttgtcctctgaatttggtctttcaaacaagggtgagagatgattttgagagtgagaagagagctgttctactggggaaaagggcacagggagggagttttgacaggtatttgtggtggccacagccagtgataaagcaaacactgcagctgagttcaggccccactgtgaacgggcctgcagttacatctcactcctctcttctgtcagttgggtcccatggggtccactggcaggacccactccaggcaggtgtccctgagcctctcctaaccacctctttctcctccatgtctttgctctctatgtggcgggggcaagaggggagcaaagggcagtagtggcttgtgtgcaggcagccagatgggagcctgaccttgggtcacaggcacacgaaaggcacagcctactgatgcactatttggcctgtgctgtgaggaggggggtgcagagggagagaggaagagagaagaaaactcctttcttctatctctaacctaggcatctagtgcatttcagtcctgaattctttcagggctcagctgaaactgttacttcagaacccttccctgatcaaggtcaggccttccacgggctttttgtagcttcctgtgcttgtctctaccagcacttattattattaccatgaattacttgtgtaaatatttattatctgtgtcagtggatgataagcttcatgagagcagagattggtgtctgtactatttatttttgtattcttatgcaggaggcctgagacaaagtgctaaataaatatttgttgaatgagtgagtgaggcaacaaatgaatcaatgagatacacaagaacatatgtataagaatgttctttggaaataacctagagtctagcaagagggaaacaaatcatggagatccatttgtttgaatatgtcattgaaaggcatatctcaaaaaatatttactaacattgaaaaattctcagaatgtaaggttaagagaaaaaagtagggacacaaaaattgacatatggtatgattcctttttctttttttgacataaagaaaatacagagaattcttactattcatggtagttatattctataaggtcactacaaacactgaattgcaaatactgaatgattgcacctaggggaaatacagagttaggctcctgcaagcctctggtcacaatatttttgtcaactgatcaatttataaccttgttttatatgtgtttctgtttaaagacaccttcttttaatatatattattgattacttaacattgaaatcatgaccaacagcactgtcacttatgcctgaaagaagcttatctaataacacacgtattttctcaagacacatcacagtcttgctatgctttggacaccagacagtgcttcagctccatgctgcaggcgattttaaaccacaagaccactaacaaaaagcatataaatatgaaaaatatagcactaagtagatcttagaaaagatacttgtttacagtatgagagctgaaacaagaaggagaggcatcaccttgtttgacttcgcctgggcatgtatgcatcagccaactcaacctttttgctgctctgagcatgtgcatgcccacaaataactgaaatgcactgtgagtattgatttgcggttacaattcaattttagcaagtaggggaatttgcaaatacaaaatctgtgactaatgaagattgactgtatgtccttaaaacaaaaaaaatctcagggcaaatctgcccctcgtggtagcgggactatggtgacataaacatttaaagatgtatccttttctttaattcctcaaatttctaaaattaacttgtattattgtataagtaggaaaataaatattatttttcttttattaggaaatggcaaaatgtgatgggcagaatatatatagagaaagggtagcaaaaatttctttggccagctgtggcacagtaagtttaaacgtaaacagccaaaactgtcagtagagtagtttcaaaaacatattgagccataactttgaaatatattttgagccgggcacagtggctcacgcctgtaatcccagaactttgggaggctgaggcgggtagattgcaaggtcaagagtttgagactagcctggccaacatggtgaaacctcacctctatcaaaaatacaaaaattagccgggcatggtggtatgtgcctgtaatcccagctactcggaaggctgagacaggagaatcacttgaacccaggaggcagaggttgcagtgagctgagatcgcgccactgtactccagcctgggtgacagagtgagaccctgtcttggtgggaggtgggggagcggggggagggggaagaaaaaaagaaagatattttgaattctctcttatatgacttttgtgaatggccaaagtatcattctgtagtcaggaacaggctgactttttgagccagggcttcaagctgaacaggagaaagagacataagcatgaacaagacctatctctgcaagcagaggtcagccacttgacaaaggcagtgcaaaggggatggctttctccggaaatccctcgcttcagctactcatcctccacctcctgccaagtctaggttaggttcccctcagcagaatgtccttctctgttctagcactccccacactgtgttgtcattacctgtatatgtctgtgttcccaactagactttaagctctatgagggcaagggctgaatgtagcttgctcactattgaattacattgcctgacacattgctttgcacgcagtgagggtgaagtaaatatttgttcaatatataacggaatgattatgcatcaaacaccccaactgatagcgactcctgtgagaatcgtcctctttaaatataagtcggtgtcagaaacaacgccaaacctcaaaaaagaatattgaagagttcaaatgagaaaattcaaacaccccaacagacagtgcctcctgtcagaatcgtcctctttaaatacgaagctcagtgtcggaaacaacaccaaatacaagaatagtgaggagttcaaatgagaaaatttcagtcttaaaaaatagacaagatttcatatactcaggcaaaaagagatagaaataagaatctgcctacgtgtgaaaggcaaatacaattcctgtttcctttatcttcttacgattgtacaccctgttcaaccatctttgggcttgtgattactgggtagtacactgctatttcttgaagtgtccataaacacagatagcagagctcaattcctgaaatgtgctcctgtttgataaggtggattggactggatcttgttcagcctttaatctacttccttaagcatctgaggatgttccaaactcaaggctatttcagtacctttgtatttgcaatgtatgatgctttaaaatgataactgtattaactttctatggcctttataacaaattgctgcaaacctaatggcttaaaacattgtaaatttattatcttatagttctatttatcagatatttgcccagatcttactggacaaagattaaggtgttggcagggtacattctcttctggaggctctaggagagagtccatttccttgcatgtttcatctgtagaaggggggctgctttcattgtcttgtgcccaccttcctccatcttcaagaccatcaggctgagttcttcccatgctaccatctctctggttccctcttttcattcccccttccactttcaaagacctttgtgtgattaagcccagcaaaataatccagaataaaaaatcttattttaaggccaaccgtttggcaaccttaattccatctgcaactttaacccacctttgccgtctaccctaatatattcacaaattctggggagtgggatgtagacatctttgggagttgatatagtttggatgtttgactactccaaatctcatgttgaaatgtaatctccagcgttgcaggtaggacctcctgggaggtgttgggttattggggtggatccctcgtgaatggcttagcgccatccccttggtgatgaatgagttctcagtctattagttcacacaaatgggggttgtttaaaagagcctgggctgggcacggtggctcatgcctgtaattccagcactctgggaggccgaggcggttggaacaactgaggtcaggaatttgagaccagcctggccaacatggtgaaactccatctctactacaaatacaaaaactagctgggtgtgggggcacgtgcctgtaatcccagctactggggaggctgaggcaggagaatcgcttgaacccgggaggcagaggttgcagtgagctgagatcacaccattgcactccagcctgggtgacaagagcgaaactccacctcacaaaaaaaaaaaaaaaaaaagcctagcatctctcttgccacatgacacgctggctccttttcaccttctgccatgattgaaagcttcctgaggccctcaccagaagcagatgctggcgccatgcttcctgtatagctttagaaccataagccaaaataaatctcttttcttaataagttactcagcctcaggcattcctttagagcaatgcaaatggaagaacacaggggcaattgctctgcctaccaaaataaatgtacacactattatatatgcatacaaactaggaaatatagtcatttatatttatcaggattcaaaatatcatgtccctatcccaactgtctactgtctgtcccctcactgcccctgaaaaaaagaaaaatatcctaagatgcaaacactcaaaccatggaatgaaatactcttggagataaaaaagtcaaatacttctcttgctatgcggatttaagagaaacatctccacagtatcagttgtgtgggagtttatgtgtaggaatctaactgctcatgagttatctccatgaagtcccgctcacagtatgaatagatgggatcctgttataatctgcttactgtttgccttgcagttgtgcatataaattatgtctaaacccttttcttcttaatcattcttctttcagaaattttgtttatctttctaatttgattagacaaggctctcctatcccccactgcttttttaacagcacagagatagcaggaggattgatcagtgactggagatccacaggggtgataagcttttctgtatatttatgtagaaggcaaaacacagcagaatgagaaatatcagattccagatttcatgtcccatatgtccccatccaaccctgtatcatgcattaaacaaataaaaagtaacagaagggcccagcatgttggcttctgcctataatcccagtactttgggagatcgagatgggcagatcacttgagctcaggagttcgagaccagcctcggcaacatggtgaaaccccatctctacaaaaatacaaaaattaggcgggcgtagtggtgtgcacctgttgccccagctacttgggaggctgaggtagaaggattgcctgagcccggaaggtggagtttgcagtgagctgagattgtgtcaatgcacaccagcctgggcagcagagccagaccctgtctcaacaaacaaacaaaaaaaaaaaaaaaaaaaaaaaaaaaaagggagagagagagaggaaataagtaacagaactagcagcatttcatattccagctaccttttccccatttacaaactcctgagtctgaaacatttgttatatttggttttgagtgaaaccagaatcaataacaaatttgttttgcattcattcctcaatatatttactgcgtgaatatggatcagcagggatggtgtgagactgccacactcaagctgggcgtttgtgcaatccacatcaacacttccaatactctcaagcaaggccaataaatcataaagctcatgtgctactgaattcagcacttcaccatcggcaaaatcaatggagatgcttccagaattttcagttttacagcttcttgaacaaatcttttcccctagtccctctctttgtctgtctggctaaggttgaggcatggacactgggtttgcctcctctccatccaccttctccatccccttttgagaaatgaccacgtggttgaggtcgatcttgtagtcaagccaattgtggtttttccatccctattcccagtgaggcaacttgttgcatgtcattcccctggcaaccaagactggttcagtttgggttgattcgatgctagcagaagttttttggggcttctaggtaaagcgtcctcatccttaagtgaaagtctcaaagagtcatctttccccatcccaaactgattctagaacttctgcaggcatcttattatagatctgatgaagtaactgtcctagaagaatcacagggaggtggagctccttccctatccctgcactcacctctccagttatgcaggaatatatgcattattcttttgtttgtttaatcctgtttgagttggagttttttgttatatttcctcattcattcaacaaataattacaactgtctgctgtgtacaggcactgctttaagcaatgtggattaaaagaacaaaaagggttcctgccttccagtaggaagagtttaaaaagcaaataataaatctaataaatcaggaaactcaacaagaacaagataaagaactagagagtgacaggagctattgggggaaagatgagagcagctgactaattttaaatagggtggtcaggtttcacctcattgaaaaatgtgatttggctcacacttggaatcccagcactttgggaggctgaggcaggaggattgcttgagcctaggagttcaagaccagcctgggaaacatagcgataccttatctctactgaaaaaagcaaaaaagaaagtacaggcatggtggcacacacctgtagtcctagctactcaggaggctgaggcaggaggaccacttgagcccaggagttcgagacggcagtgagctatgattgagccactgcactccagcctgggtgacaaagcaagatcttttctcaaaaaaaaaaaaaaaaaaaaaaaaaaaagtgtgttttgagtagacttttgagtgaatgagcatttgtggatatttggagaagagttttctaggcagaggatactgccaacacaaattccctaagttggaagcttgcttgggaatgtgagaggagaaaggagtggtgggagtgaagtgagggagggcaggggttaacagggagccctgtgggtcttttagcccagtgcagaagcattttgtttggctttgactctgattcaaatggggaaccacagaaggcttttgagtagagtgaaaaagatcactctagctactgtgttgggaaaggattttggagcagtaaaggaaggtgcagggagctgacttagaaggccacagtcccatgccaggctggagatgctgcagcagtggtccagggttgtagtgatgaaggtggtgagcagtggtttggattctggatatgttctgaaggcagagccaacaggatttcctgagtataggggaatgtgggagaaaagcaaggagtcaaggatgactccagctgaaagcaacctaaatcattaactctcaaatttacctgacttgattatcagctatttacaactcatgaatgttacataccatggagaagtccaacccaaacacagggttcacacgcaaaccagtaatttgatattgagggctctacatgttccattaatcacatccccctacttaaaatattttccttggctgccttttaagaataaagttattttccatagtctttgagagttaactcaggtaggaccgaagtgatgaccgttctgtcctctgcagcaacgccattgccctttatccttgttgtgatgtggttttcctgtgtcttctgctgctagatgtgatgacgatatccctcctttgttgatggactcagcatctgtacatgggatattttgactccaattttcctgatgcatcatcctaattgtctggtagttactgactgtcacttaccaaccggtgtgagatattcttcagctcttcatcaggaacagaattacagcctctatctttagaaatgatatatgctgaggattattcatgtttgtaattacaaatctagcagaagtgcaattattaaaaaaaaaacccttggaaaggacattttgttgtataacgcagaacctgctgttagcctcttgtgctggtattacttttgttgctgtaattgccacctgcatttcagttgtaatttaacattatctgtcttctctgtatctttctacctgattgtaattgttaggactcctgccatttattcttaaatactttcttgtctttctgaattactgggctattttctatgattataacctaagaaacagctgcagcaacccttgttgcattgtaaaaacttcagagggctggtttatctctagtttaaaaccagtgaagcaaacagtggggggaccttcggaggtcattcacataaaaccatcattttaagaatgaagaaactgaagcttttgagtgattaactaagttgctcatgatcatttacattcttattgttatgctgtactctggagtagcaagtatggatatatattcagagataggatcttttaagtcctagcactttgcaatttatgctgattaaccaacgacctgccaaacagagctcaagatgggaagggaagcgacactaaatcctttttttgagccagatactgctaggtgctttgtatcatggaccacattgatatgcacaataatctgatgaggtaggaataattatgccaatttctctctctctctctctctctctgtctctcacacacccacacccccccccacacacacacatgctgggatttttgggagattaagcaacaggctcaagagcacacgggtagtaactctcaaatagtaagaactgcttgactttccaccctttctctttctaccaaatcaggaacagaataatggatatcttccaaaggggtgagatatgagcatgagctactttttttttttttttttttttttgagatggagtcttgctctgtcgcccaggctggagtgcagtggcgtgatctcggctcactgcaacctccctctcctgggttcaagggattctcctgcctcagcctcccaagtagctgggactacaggcacgtgccaacacacccagctaattttttgtatttttagtagagtcagggtttcactgtgttagccaggacggtctcgatctcctgacctcgtgatctgcccgccttggcctcccaaagtgctgggattacaggcacgagccaccgcacacggccaggtatgagctacttttaaggcagttggaagcccaaagagcttgggaaaccatgaagactaggcctcacaactgcagttttctcaggcctatgcagctgcctccatccttttgctctgagcaaaactggacctagttaagcaatgttgcccaactgttaaaaaaggaagctcaaaactaggaggtaggatgccagataatttgtttaaatttttgatctttaaaatcttgactctttgagcttgttttgagcctcattggtccaaagtggctcaatctgactgaggaaggggttggaggaggaaggaatgtaaaaatgaaagatcggtgggaaaaggatactgccttaggttgtctgtaggtaaataaaggtttgactctataaaaactctcttcctgaaataatcaagaatgcttcacatcagaagcatcaattaaatggctgccttctttttgttaattctttagtctttagctatttctgctgttgctgcagaggcagagagatggtgaaagaatcaacctcaggaaatagtatggaggtcaagggtcagctaagaggatctactgattttctgatctgcggagctttctgagtgagtctcccttgaattgcaggagggcatccaataggaaacccagtatgcaacaatctcaagagatagcctctagaacactgggattagcattaatccatgaaaatgaggtgctataatgatgatgatgatgagactagaacctatagttacatgcattgtgggaaaggtttgaattgaaaggctgaaggagggagtggttgtcttccaagagggtatgatggtcatgctgaatgaagaatgaagtgaaagaagtcagtgaagatgcattaagaccgtaggtcaggttcaagtagtaactcccaagggttcaaccacataatgacgcattgaaggatgtctattacaatcataagaaacagcaaagtggttgagtatagtggctcatgcctgtaatcccagcactttgggaggccaaggtgggcagatcacttgaggtcaggagttcgagaccagcctggccaacatggtgaaaccccatctctaccaaaaatacaaaaactagcagggcatggtggtgcccgcctgtaatcccagctacttaggaggctgaggcaggagaataacttgaacctgggaggcggatgttgcagtgagttgagattgtgtcactgcactccagcctgggtaacagagtgagactctgtctcaaagaaaagaaagaagaaaagaaacagcagagtgtcccatctgtcctgcgagtcctaaggaaactgattaatggcttcaaaagtttatttctcatcaaaatgaacttgattaattacaaatccagattttttagtcctgccccccaaaagtctgattttaccaatgaaaataacccccaggtaattcctgcaagcagcctcactggaaacatctggggtaggtgaccccaacttctgtcattgtgagtttctgtgtgctacctttcttttttggtttttgtttttaataaacagggtgttgctctcttgcccaagctacggtgcagtggtgcaattatagctcacttcagccttaaactcctgggttcaaggaatcctcctgcattgctgggattacagatgtgagccactgtgtcaggctctctgtgtgttccttctaatagtacttctagaacatctcttatttttttcttttccagctcggagattcttaatttgagtttctggggctcaatgaatagggcccaggggatctacaacccccctgaaattacatgcagaatttcacatatatatgagctatgtgaagagtctcaaaggaatctgtggtttccaaagggtttagaacaattgctccaactgttctatttatctcctttctgccctgacccctggagctggttcacagctttttatcctggccagtcttcctggctttagtggacagtacatttgtctttgactttgaaactttacattaactatgagacatagcgtgaaactttggaaagagaggggatcacttctatgtttctattaaaattaatttcctttggaagaatatgcctgtgacagttttcatagaacactgctgtccccattttaatgagaaacaaaaaaattcatccacgtcaccaatattctattgtgtctcttttctcccagaagccgatctctttgctaaaccatcttcagcacagctccagttgaagtcctttgcttgtctgggtcctttgttgccctcccggtgttctgctgtccacagaatatagccctgactcggtagcctggcatctgtgccctttgcaatctgactacctcctgctgctctcctaattgttccatgttccaagctaactgtgctcctcgccattgcccaagccctgtctgtgccctcttccctctgggcctacaggggatgccctccctctcctctccatctgtcaccgtgtacccttgttcaaggccttcatcccatctctccgtcagccagaaatttcctcttctgtgaacatcaattgtacttggttcatacgggtcttatggcatttgttacatattgatttttgtttgattatgcatgatttgtgtttctcttttttcttattagattccaagacctttcatcacagggcctttgttgatttaactgtgtatctggtcaattgcctgtcacagtacctagcatacaaaaagccctcaataaaatctggtgaatgtatttaaaaacctagatagggctattttaattcagaaaaataaatctgtttgccttttttcctggtaatctaagttgggcagttgcacgagaactgcatataaactgcattcaactcttgataaattagaaaagtcatctgatggcttcattaaaatgtgggctttaaaattatttatgatttcatttttcataacatctttgtgagacttgtagtagtgtagtattccccccgtcttttggatggtgatttcactgaggtgagaggttaaagtgggtcattcaaggccacagagcaggcaggtaacaaaactggcactggaaccttggcctcctggggccacgttagcagagcgtagcattgactgcactaaggatggaatacaaatgtgcttacacattgtcaaatcctgtgggtcaaaaagtttgttttagtgaaagcatcacagataatgaagtatttgaaattttctcttttcaccttttggcatgcaggctcctctctctctgttccctaaataaggacacgtctgtaggtctgatcctcagccctgtctgtctgtgaccttctccagtatccaggaccctcggcgatcaatacctgcctcgtggtttcaatgatcatcactctgctgacttacctaacgtctttgcctatggtgatgacccctgcctgctctccacctcacatctcttgtggtttaccagaagtttccacttagaattctgccatcacttcaaaatccagatatctaaatccaaactcatcatctgctctctgaacaaacttactcctttctcaatctacatttttctaccataattctcctagtcatccaagttcaaaatcattgttatctttaacttcctttatttttttaagagacagcttctcatcccactgcccatgctggagtgaagtggtgcgatcatggctcactatagtttcaaactccggggctcaagtgatcctcctgcctcagcctcccaagtagctaggactacaagcacacatctctgcactcagctattttttttttttttgagacagaatctcactctgttgcccaggctggagtgcagtgctgtgatcttggctcactgcaacctctgcctcctgagttcaaacgattctcctgcctcagcctcctgagtagctgggattagaggtacctgctaccacacacaactaatttttgtatttgtagtagagatggggtttcaccatgttggccaggctggtcttgaactcctgatctcaagtgatccacccaccttggcctcccaaagtgctgggactacaggtgtgagccactgcgctaggcctaatttttaaatttttgtagaaatggggtcttatgttgaccaggctggtcttgaactcctagcttcaagtgatcctcctgtcttggcctcccaaaatgctgaaattacagaaatgagccactatgcctggcctgttattttcagctttttaattggctttgtcttattgatacttccttcaaaatgtttatcatgtccatttgagaatctagagtggtttttttttttttttttttttttttttttgccaaggattacctctttctctagagccctccacctcatgcacattcctttctttctattttcattaccacattgtgatctaggtcttctcttcctcttccttaaatttcactggtgttcattttgttacaggatgaaatccatagtcttcaacctggcatacaaaacctcccacaagctgactccagttgatctttccaactttctagtctaatacttgcctctggtaattttttttccaattcttctgttgactgtcctggaatgcatcttacatggccttgctttggtcctcagtttagttcttttattttccagtttactcctttggatacttctcatcttcaaggtccagctcatgtctcatctttttgatatgaccattcctaattatttaaatccatattctgaagttcttggcccttgttgtctacatctttgctgctcaaagtgtcattaaatgagcagcagcattgtcaccacctggaagatggttagaaatgaatcttggggctctgcctcagacctgctgaattcaaatctgcattttagcatgatccttgaagtgatgcatgaaacacttgtctgtcccatttagatacttagataatactcaatccaaacaccaacttatgtacttatctgcactcctcaagatccttgaaatctgcgaacctgttttatttttctttagtatctctgaaacacaatttcatggtaaagtaggtgcttactaaatagattttagtgtccttctctttctttttctatttaaaggaggaaaaaactcccaagactcctagaaagtgagcatgagctgctatagtttgaatgtaacctcttcaaaattcaggtattgccaatgagatactgttaagaagtgaagcctttaggatgcgattgagccattagggctcctcccttgcaaatggaacaaggtcagcaaaccaataggagtgctaaggtaaatgactgtagaacaaaatggtgtttatgtagcttgatggtacatgtaatttcacaattgcattttgtgtctgaaaaacatatgaggttttgctaagcttagtagagaaatgcctgctttgtggcaatgttgtccattagttaaccagagagaaatatgagaacagatgatgtcactatattcttccactagcctaggttcttaaaagctctaagactacaagtgttatagatgactccagcatgcactcatactgctacttaactttcttcatggaaatgtgtcttattctgtcaacagactaaaagaggggcaaggacatatattatataattttgtatatactcgataatgctcaggacatagagcttcagttccttccctccctccctccctcctgcccaccctccatttctttattcctgcctttcatcctttaagtgtttgttgagtgattgagatcaaatattgatatattgtatctatagaatagaatattctattctagtgctattatatatgctggggataaatcacgcattaaaatgaatgtccttctctttatggaacttgcattccagtggagcaaaaagataaacaaaatcataagaggaatttatacttagaggacgataagtactgcagaaaaagattagagaagagggcttggaattggggaggtatactttaaaataaaaagccagagaagaccacctttgagaacataatttaagaaaagacttgaaggaggtaaattatgtagctatctgagggaagaccttcccagagagtggaacagcaggtacagggctgaggtgggcatgaacagggaagagtaagaacggtcttttgggtttgaagtagaaggagcttgcaggagaatgacaggagagatgaggtcagatattacatctcaataggatctctctggctgcaatattgagaaaagccagaagggggacaaggtggaggtgggaagacgaattagaaggccactgcaataatacagacaggagatggtggtggcttagaccagggaggcagccgtggaagaggtgagaggcagttacattctgcatatattccgagagtacagccaacaggatttgctgaaagattgaatttggcatatgagagacagagaggcatccaggatccaggcatttaagatttttggcctaagcaactagaaagatgcagctgccatcaagtgagatgggggaaggctgcggtggagaagtcttttttagggaagattaggaacttagctttggcaatgttgagtttgacatatcttttagacaagtggagatattgaggaggcagttgaatattggtggaatgaacgaataaccaggatcttaatcaagtgtttaactcccttaaacataaatcaactttttgtctacttcctcataatgtgaagcactttgggatgtgacattggaaatcagactcttctgaccaaggcccaggtctgcctgaattccaggcctagagatctgacaatgtgctggccatcttcccttaaatgttctctagagccacaccatgtctaaaatggaacgcactctctttatcccaagcctggtctccctctttgtgactgtggtgagtgggcaccactaggcatgtaagctggcagtcacacttcattccttccatttcctcatctccatatctaattggtcaccaaatcttaccaaccccacttccaaaccatctctagaacccatctcccccctccgtcttcactgctgcttttttggatttatgctctcattgtctctcacctggattatatgtaaatcttctcctacctggtttcccagtctccaatcgatccttcacatagctcccagagtgattttctaaaatgtaaatgtggccatgttactcttctgcttaaaacatttccaaaggctttcttctgtccataaaacccaaaacttgagtttggcctgcaaggatcatcaagatctggctcctgcttatctcttagatttattatcccccccatcccccccgtcactcctatccattggccagattatactacctgtagttagttaacttattcattcaattttcagatataaataggatgcttcatatgttacaagcactatgctaagctgtgggggatacaaagctagacattgaaaaagcctgaaataaacctggttgtcttccttcctacttacttacagtcgtcatacagtaagctgtggggatacaatgctgcattgtacgcagacttggttcctgccctcatgaaagtatactttctcaatttccatgcctttgctctctgaaccccctgccttgaatttaccaccatctgctcctccctccatctcactgccatgtcctccttctcctaccagctacttaaagaataccatctcaacttttaagaatcagcttacatcattcccttgtattaagctctttactctatctccttttctcttctaaaaatgtttcctccctcaaaaggtatcattgaaaaacttaatagctctagaagtgaggatatctctaaatacattccaggttcagttcagaatattgttttatcttatactagaagatcatagctcaaggaatgggatttccttctttatcccaaaagggaaaaaagcctccttttcctggatttttcccatgctccttgggctccacaagtgggataagcaattgttaacttgctgcagagtgagtgaacccaattgcattggattcacacacagtggatgctccaggattttttttaaatatttatttatttatttatttatttatttatttatttatttatttatttattttgagacggagtctctctctgttgcccaggctggagtgcagtggcgtgatctcggttcactgcaagctccgcctcctgggttcacgccatgctcctgccttagccttctgagtagctgggactacaggtgcccaccaccacatccagttaatttttgtatttttagtagagacgggttttcaccatattggccaggatggtctcaaactcctgaccttgtgatccacctgcctgagcctcccaaagtgctgggattacaggcgtgagctgccatgcccggccttcaggatttttaaatagtaaagcgttaggggtggtgagctgattggtaggggtgctaggaaacttgtcttaaagctaagtttgcatagctagcttacaattttcacttagattaatatacatagatttatagtagcttgtgggggactgataaagatgtgggttaaagattccttttaaagccatcccttaatgctaccactgtacagaaagatggcagagtgactgcctttatagacacctgcccacacttcctaatctgccctcagttgcaactcctagagagtaggcacacagcttagggtggaaaatacatgaaaattcagtacttgtaaatagatgggaggtgggtaatgaggatgagcgacagaagaaaaaaccttctatatttgtctgttctcaccacctaaggggttcttcagaaaaccagtgagctttacgctcaggttgagaaatccttgttacagtcactttaattgcaatctctatttcttctctctttttctttctctctctgtgtctctacacctctccctcaccactttctggatatgcacacatatttacattcagatgattttagaaagctccattggggaataactataaattatgaatatgcaacagcactaaaaccaactattatagtcaaaaatcctgaaataaacctcctggttctcttccttcctacttacttacagtcagcacacagcaatatatcttagagtgaggctaaatggatatctgatactcactcgaatgtgataggcagtcaacaacccagttatcactgttgaagcattttaaggactacttccatgtcactctggctatgataaaaaccatagtctccaaattggtacagtaggatgaaccttccatgacgactggtagcatgtgtttgattacacatatgtatacatacatgtacacacaatacacatacctaaacattataaccagattagtatattccttttgcattgtactgaatactttaaaataatgtttcatcagtgattgtcagagttataaaatcatttgaatatattaataagctataaacattttaattttaaaggataaaatatgctgcacaaaagagccagtacagccactgcttatgtgtttaatttatttaaagagatgcctgttctgttattacttcaaatatagttatatctacatgtaagtgattttaatttgctacaacatttagatgtatcaatgagacatttcataaattaaaattgtatcacgtagggagactatcttgattatgaagctttattaggtgatgattataagtgccttgtttaataattataacagcttaatggctcctgtagttatactttataataaaaatttcacatttaataatatggaaagggatggtacacagtgaactgacaaaaaagtattgattctgaacctttaaattggattcctattgatctgatgtatgaatattttattggtgtaaatgttttcagggttgccagtttctattactgcatgttagcaattttactggctatgtataatggacaaattaaatgccaggatatgggcatatccagcaccccacactgattattttgattcacttatcactatacactactagggccttccctttctctgtcccatctctgttctggaaggtgagccacagacttcttctgtacatgcctcagatacatgacaagccagtgatgggtggtctggcttgttatctggtagaggctgggtgggcatgtgtctcttcctgctaaggcccacagccccttagctaagacttacacatttgctccaaggccagtcatttgggcccgagtacctaatggataataacaggggctctgggattaggtagagcaagatggctgaacaaaagcttcaaccaattgtcctccccacaggaacaccaaactgaacaactatgcacacaaaaaagcaccttcataagaaccaaaaatcagcttaggtaccagcttggccacagtggagtagagcaccaagcaggctcttggggtccctgattccaggcctagctcttagatggcatttctggacttgccctgggccagaacggagcccattgcccttctgggagagtcccagtcctgccagcattcatcacaagctgactgaagagctcttgtgccttgagtgaacactggtggtacccaggaagtactcaccatggacctagggtagtggtgatcacagggagagactcctctgtttgtggaaaggggagggaagagtagaagaactttgtgttgaggtatgtgttccagctcagccacaatcgagtaaggcaccaggtatattcctaaggtttctgactgtaggacctggctcctggatggcacctctggacccacccagggtttggggaattcactgccctgaagggaaggacacaagcctggctggctttgccacctgctgattgtagaaccctagggctatgagcaaagataagcaatagccaggcagtggttaccacaggtgttgggtgagacccaatgctgtgctgacttcaggtctgacctagcacagtcccaagggcaatggccacaagggtgcttgtgtgatcccacccacagttctaggcagctcagcacagagagagagagagagagatgccatttgtttgggagaaagtaagggaagagaacaagagcctatgtctggaaatccaaagaattcttccagatcttatccaagaccaccaagtacctctaagagaccgcaagagtcacagtgttactagactcgaggtgccccctaatgcagttatggctacagtgaccaaaaacttagatcacaacactcaagtccctttgaatacctggaaggcccttcccaagaagaatgggtacaaacgagcccagacttagaagactacaataaatatctagctcttcaatgcccagatactgacaaacatccataagcatcaagaccatccaggaaaaataatcttaccaaacaaactaaataaatcaccagggaccaatcccagagagacagagatatgtaacctttcagacagagaattcaaaataactgttttgaggaaatgcaatgaaattcaagataacatagagaaggaattcagaattctatcagatacatttaacaaagagattggaataattaaaaagaatcaagcagaaattctggagttgaaaaatgcaattaacatactgaagaatgcatcagagtctcttagcagaattgatcaagtagaagaaagaattagtgagcttgatgacaggctatttgaaaatacacagtcggaggagacaaaagaaaaaaagaatgaataagaatgaaggatgcctccaagatgtggaaaatatcctcaaaagggcaagtgtaagtgttattggccctaaagaggaagtacaaagagaaataggtgcaggaagtttattcaaaaagataataacagagaacttaacaaacctagagaaaggtgtaaatattcaagtgtaaaaacaccaagcagatttaacccaaataagactacctcaagacgtttaataatcaaactcccaaagatcaaggataaagaaaggttcggaagaaataatataaatagagttccaatatgcctggtagcagacttttcagcggaaaccttacaggccaggagaaactggcatgacatatttaatgtgctgaaggaaaaaaaccttttatcttagaatagtatatccaacaaaaatatcctttaaatatgaaggagaaataataactttcctggacaaacaaaggttgagggatttcatcaacaccagacctgtcctacaaaaaaatgctaaagggagttttcaatctgaaagaaaaggacattaatgagaaataagaaaacatctgaaggtgcaaaaaactcacaggtaatagcacagagaaaatcacagaatattataacactgtaattgtagggtataaactattcatatctcaagtagaaagactaaaagatcaaccaatcaaaaataataactacagccacttctcaagaaatagacagtacaataagatagaaatagaaacaacaaaaagttaaaaagtatgcagtgggggggaatgaagttaaagtgtacagtttttattagttttctctttgcttgtttgttagtctatgcaatcagtattaagttgtcatccatttaaaataatgggttataagatagtattttcaaacctcatggtaacttcaaatcaaaaatcatacaacagagaaaaaatatgcaaaaaataaaaagcaagacattaaaacataccaccagagaaaatcacctttactaaaaggaagaaagaaagaaaagaaagaaggaaggaaggaagagaagaccgcaaaacaaccaggaaacaaatatcaaaatggcaggagtaagtccttacttatcagtaataacattgaatgtaaatgaactaaactctccaatcaaaagacagagagtggctgaatggataaaaaaaaaaaacaagattcaacaatctgttgcctacaagaaacccgcttcacctataaagacacacatagactgaaaataaagggatggaaaaaatatactatgcaaatgtaaactgaaaaagagcaagaatagctatacatatatcagacaaaatagatttcaagacaaaaactataagaagagacaaagaaggtccatatatgatgataaaggggttacttcagcaagaggatataacaattatatatatatataatatataatatatattttcacccagtgctagagcactcaggtatataaagcaaaaattactagagctaaagagaaagatagacctgaatacaataatagctggagacttcaacagtttcagcattgaacaaatgatccagacagaaaatcaacaaagaaatatcagatgtaatctgcaatacagaccaaatgcccttaatagatatttacagaacatttcatccaacagcctcagagtacgcattcttctcggcacatggattattctcaaggatagactgtatgttaggccacaaaacaagtctaaaaaattcaacaaaattgaaattatatcagtatcttctctgaccacaatggaataaaactataataaatcagtatcaagaggaattttggaaaatataaaaacacacggaaattaaatagtatgctcctgaatgaccagtgggtcaatgaagagattaaaaaggaaataaaaaaatttcttgaagcaggtaataatggaaacacaacataccaaaacctacgggatacagcgaagccagtactaaagagaagtttatagctataagtgcctacatcaaaatagaagaaaaatttcaaataaacaatgtaacaatgcatcttaaagaactagagaagcaagagcaaaccaaacccaaaattagtggaagaaaataaataaagatcagagaagaaataaataaaattaaaatggagaaaacaatatgaaagatcaatgaaacaaaaagttgggtttttctttttctttttttcctttctttttttttttctgagacagagtttggctctgtcacccaggctggagtgcagtggcatgatctcagctcactacaacctgaacctcctgggttcaagcaattctcatgtctcagcctcctgggtaactgggattacaggtgtgccaacatgcctggctaatttttgtattttttgtagagatggggtttcaccatgtaggctaggctggtcccaaactcctggtctcaagtgagccacctgctatggcctcccaaagtgctgggattacagggatgagctactgtgcccggccaaaaaaatgattttcttaaaaagataaacaaaatttttgtcagttgacaagacttaaatctaagacttcaagctatgaaactattaaaagcaaacattgggaaaactctccaggcaagtgatttcttgagtaataccttacaagcacaggcaaccaaagcaaaaatggacagatgggatcacatcaagttaaaaagcttctgcatagtaaaagaaacaatcaataaagtgaagagacagcccatttaatgggagaaaatatttgccaacgatccacctgacaaaggattaataaccagaacgtataaggaacccaagaaactctataggaaaaaaatctaggccaggcgtggtggctcatgcctgtaatcctagcactttgggaggccgaagcaggtgaatcacctgaggtcaggagatggagaccagcctgaccaacatggagaaaccctgtctctactaaaaatacaaaattagctgggtatggtggcccatgcctgtaatccagatcttcgggaggctgaggcaagagaattgcttgaacctgggaggtggaggttgcggtgagtcgagatcgtgccattgcactccagcctgggcaacaaaagcaaaactccgcctcaaaaaaaaaaatctaataatcccattaaaaactgggtgaaatgtctgaatagacatttctcaaaagacatacaaatgaccaacaggcatatgaaaaggtgctcaacatcactgatcatcagagaaatgcaaatcaaaactgcaatgagatatcatttcatcccagttaaaaaggcttttattcaaaagacaggcaataacaaatgctggtgaggatgtggagaaaagggaactctcgtacactgttggtgggaatgtaagttggtacaaccactatggagaacagtttggaggttccttaaaaaattaaaatggaactatcatgtaatccagtaatcccactgctaggtatatacccaaaagaaaggaaatcagtatattgaagatatgtcttatctctgtactcccatatttgttgcagcactattcacaatggccaagatttggaagcaacccaaatgttcatcaacagatgaatggataaagaaaatatggtacatatatgcaatggagtgctatccagccataaaaaggaattagctcttgtcattgtcaacaacgtggatggaacacgaggtcattatgttaagtgaaataaaccaggcacaaaaagacaaacttcacatgtcctcacttatttgtgaaagctaaaaattaaaacaattgaacacatgaagatagagagtagaatgatggttaccagaggttgggaagggtattgagggtgcggggaagggacggtgagacagtggggatggtaaatacgtataaaaatatagttagatatttagaattaataagatctagtatttgatagcacaacaggttaactatagtcaacaataatttattgtacatttaaaaataatcatttgtaacacaaagaaaggataaatacttgaggtgatgcatacccatttgcccatgcaataatgcctgtatcatgcctgtatcaaaacatctcatgtaccccataaatatatacacctactacatacctacaaaaataaaaaaaaaacccctggactctggagtcagattcattcaattcaaataatatttattgagagccaaatagcagacattgttccaggtgctaggaacagaatcgtgatcctggcttcatggacttccattctcatgattgcctaggttcaaatcctaactctacctcataacctcaggaaatatgttttactgtctgaacttatctcttaatttgtaccagattcatgtttgttgcaagaatttacagaggcaatgtatataaagcatccaatatcatgcctagctcattgcaagtgtcacttatttttatttttgggtgaaagtctgatgcaagccatatttatgccataaatttaattggatgtgaatatgatctactagttgaaatgactctgatttctatgctttttaatctagtctgagcagcatttatgatacagtaatggccaaaagacaatgaaaacactattatttatcttaataagacaatcctaagccaaaagaacaaagctggaggcatcacgctacctgacttctaactatactacaaggctacagtaaccaaaacagcatggtgctggtaccaaaacagagatagagaccaatggaacagaacagagccctcagaaataataccacatatctacaaccatctgatctttgacaaacctgacaaaaacaagaaatggggaaaggattccttatttaataaatggtgctgggaaaactggctagccatatgtagaaagctgaaactggatcccttccttacacctcatacgaaaattaattcaagatggattaaagacttaaatgttagacctaataccataaaaaccctagaagaaaacctaggcaatactattcaggacacaggcatgggcaaggacttcatgtctaaaacaccaaaagcaatggcaacaaaagccaaaattgacaaataggatctaattagactaaagagcttctgcatggcaaaagaaactaccatcagagtgaacaggcaacctacagaatgggagaaaatttttgcaatctactcatctgacaaagggctaatatccagaatctacaaagaactcaaacaaacttacaagaaaaaaacaaacaaccccatcaaaaagtgggcaaaggatctgaacagacaatcctcaaaagaagacatttatgcagcccacagacacatgaaaaaatgctcatcatcactggccatcagagaaatgcaaatcaaaaccataatgagataccatctcacaccagttagaatggcaatcattaaaaaatcaggaaacaacaggtgccggagaggctgtggagaaataggaacacttttacactgttggtgggactgtaaactagttcaaccattgtggaagacagtgtggcgattcctcaaggatctagaactagaaataccatttgacccagccatcacattactgggtatatacccaaaggattataaatcatgctgctataaagacacatgcacacatatgtgtattgtggcactattcacaatagcaaagacttggaaccaaccaaaatgtccaacaatgatagattggattaagaaaatgtggcacttatacaccatggaatactatgcagccatgagttcatgtcctttgtagggacatagatgaagctggaaaccatcattctcagcaaactatcgcaaggataaaaaaccaaacaccgcatgttctcactcacaggtgggaattgaacaatgaaaacacttggacacaggaaggggaacatcacacaccggggcctgtcgtggggtggggggaggggggagggataacagtaggagatatacctaatgtaaatgacgagtaaatgggtgtagcacaccaacatggcacatgtatacatatgtaacaaacctgcacgttgtgcacatgtaccctagaacttaaagtataagaataaaaaaaaatgtagtcaattgtggtgagtcataggagggatgccaagtgtggaatcaccacagatgccagtcaaggctcaacgtgaccagctgttcagggtgctttgacaatcccaagccttgaaactacctaaaggctccttctgagtcaaatatcaaaaaaatggatcccaaatgactcctaatatgatttctcccagatgctctttctgataactttgtttccgacgttgatatctgatgctctcctaattactttggaccactttcttcctggaagactctatatggctcttatcattgagcagctctttgcaatgaagatgggaaaagacctccactatcttctgttatgatctaaggccctcgatgaggtacccattgcctccatgtatcttcctgggaaggcctttctgaggctttggctggtatcttaatttcttgtggaatatacatactggtgttctggtgctgtgatgtctggatatgttgaggtattgaccataccctggccagtggttttccttttgtttatatggagagagtccctgctctggcaagggaagagatgaagggaagagagggtagaagaggggaggggagggaagaggaggggagaggaggggaggggaggggagggaacaatttactgtgcctttttaaaaagagatcagccaataaaaaggtagattttggagacagacaaatctaaaaaaaaaaaaaaaaaaaagaaatgaaggttccaaattgatcacctaaatcatacagtcctttatcaaaatgcctggaagcctgtctaggctggaggttggctaacagcatacactcagctgacccggggagtactgatttattttcctatgttagaagttaggcctcatctgaaaggcagagagaagggcatcatcacactctatgccctatggactgggattggggtgggcactggagactattcaagagggcatttttgggaaaataggaagagagctcatggtggaagacagggaaagtaccagtagaagccgcattctgacaacattccacaaggagagaagctaattaaaaatgggaacctgacataggccaactaaatgagtatctctggggctgggatctggcagtgatctttcataagaaaaactcccctagataattctaacatagccagaggtaaaaacaacaacaaaaaaccccactactgctccagactagtagttctcaaagtgtaattcgcagaccagcacacgtgggtatttgtagaagtgcaaattaacaggaccccccaccaccccagatctactgaaacagaaactctgagggtgggactcaggaatctgtgtcttaacaagctctccagtgattctgatgcttgctcaagttggagaactactgctctagataagtcataccagaccaaaaaaacaaacaaacaaaaaaattaggaaggtcaggaaggcaggcagggtaaaatggatcagggtggaagtccactgtggtttccttttgtactttagagaagaatgaaaaacgcacattgctcacttccatacaactttggagaggggaaggtatctaacccttcacctttctctctcctaaagctccttcctaggagccattaaatgacagaggcctcttggttccaagtgggttttaggatttttaaataaaatgcagagactaataatgaaatttgttggaccatcagaaaggacagcagatggcccttgtgcctaggagggagggagggagggtaaccgctttccagaccaggaaaaaataaactaagaataaaaagaaaaccaaatgattaaaactgaactttgctttacttttcccttttatttcatgaaagcagtgtttgggcacagtagagatatgttaataaaattgaataatgtctcttgcactaagttttcagtacaagatgaaaactgcataagaacatgttctaatgatgcgttggttttctcacagtaacatccagcccccagaacattctctggcagcacccacactctcctgtcctagtgaataaacctggaacaaagctgaaaatctgaggagctgccgcctggatggggaaggatatgcttgtgaaatgtagcttggctctgttgctgacttagatgggagtacaggaaagtcattagtttctctggccctcaattttctcaagtaggaaatgacagaaaccacccaaatgaactgaaatgtcaaagtgatctccacaggcccaggaagagggccaggtgccatagccaaacaggatagcagaaaatcgcacaggctcatggtgtcacattctggtaaatgggcatgatgaaatttaactaagctgaaaaactgagaagtttagtgatcaaatgtgggccaaacattctatgggcatttttgttgttgcttattttaatggtcttttcctcctcatactcacatgctgtgcaaaaattatataattatataaaaaatatgaattatataagtaaagaaccccaaccaaatctcaactgattttgtgaaaaagaaatatcttttttttgcttactcttaagttctttttatcagaaaacaaataccacatgggattattattttaaacacaagctgcatttaagagaaagtgtctagtaaaccttctggggctgtaaattagctgctaattttgtttgactaaaggctgtaaaatgcatttctgggaattattgtgcacagagaacatcctcctaatacttcagtgggcttgaacagagaaatggaatcctattcagtatacctgttactaaactgaggctactccacgacccaggctcattctatctaactacatagccagcttttctggatttgtgaaagatgagattttgggaaagaacatgagaaacaatgagtcattcacagacacataagtagagatttgaaattggtgttcagaccatctaatcttcacatttcctcctttgttcaatctcattccagtctctgaaattttccaagggcctgtttattactctgttctattcacctactgctatgttcagttactgccccctgtttctctaatggagttttgctttcaagactgggcacaactcttctcaatatgtatttacatttttcatttccttatacaagttccatcattttttctttatgatagttttctttaacctgtttattcatttgtttcatttgttatattttcatgttttttatcctggtccttattttcctccatgacacctcttcttatacttgatgttgttctctagaatgctgttaaatttgctacctgtctctttcaaaatttacctgggcaatggtagcacacaaagggccatgcagacttgccaatattaggctggtttggcctagcatagtacctggcacacagcaggcattcaatcaatatctgttcagtgactgcctgaatgaaaatagaaatgatatcagtagttttttgcaataatcttaagcaaaattataaactaataacttccactcctttaaatgtgtgtcaacttttctgtactaattggaaaaacatctagttcatgtggatcaaaattgagtctatatgctacgtagggcaaaggcatgcctggattttaacatctcatcctcagtgactctaatggtgcctggcacagaggagatgcccaataagtttatatgaaatggcttagaatggactaccttctccatgcgactaatgatctgttactacttcctgaaaggttagccattattgatataccacttctagatgctgtgacaaatggcacagctcagcagcaaaagtactttttaaagtctatgggcctccacaggttgagtttgaaaaggatctgttaatcctctgaaattacatgtgatttatggggagaaagtttacaaaattattaatactcttgaaggggaatatgacctccccccaccccaaatttcagaaccacagtggataatgaaagtttctatgctgtaagagcaattaggaagtcctgaaaaacagggaatttagtcaggagacttgagttgaaatcctaactctgccccttgctggctgggtgaccttggccaagttttaaactctttcttatcttcagtttccttattatgacatggtgatgttaatgacaagtctctagacatagtggttaaacttcaacttgaacccaaatttttctggctctaaagcccaggctcttaacatctatcatcctacattaattaaatgagataactgatgtgaaaatgcctgatgtaaatatttgttaaagcaacaacaaaaaatgtcatttgtcaaagtaacaaagtattttttaaagtaacaacaaaagagacagataaccacaaagaaaaggccactttagaaattcctctttgacctattaaagaatgttcaagttcaaaatatgtttgtcattatgattaaaaatccaaccccaaaacttgggtgaagacggcataatctgttagtttggatatatacagactaaggggattctttggaataccctttgtctagagtgatcttatgacatggtacggataactagactcacctaacattcaaatgaagggctgtgtgtcttctatactttgtagacagaggtggcagatcatctgcttttaaatatagagggctcccattctgctaggatccagagggaatgagggtcctatgttacagatgtccctctgcctgcacaaaaggctgaagaacaagccatcatggagtgtgggagatccagctgttgtccatttccagaagaggagtgaatagtggcttaacagagaggacccttgcctggttctctttggaaatttcacagtagtgaggccaggtgcggtggctcatacctgtaattctggcactctgggaggctgaggcaggtggatcacttgaggtcaggagttcaagactagcctggccaacatggtcaaaccccgtctctactaaaaatacaaaaattagccgggcgtggtggcgtgcacttgtaagcccagctactagggaggctgaggcaagagaattgcttgaacccaggaggcagaggttgcagtgagccaagattgtgccactgcactccagcctgggcaacacagcgagactctgtctcaaactaacaaacaaaaaatttcacagtcgttatgaacagataatatgctcaggtattagccatttcattgcattgttttgacaagtgacaggaattaggtttgctaatgttggaagaaaaatctcacttgttgcttttaacttaaaccttttatggttttgagataggtttattcactgggctggagaatgaaggatttatctgtattagtcggatttgatcagttttcaagtagctactcagtgtcaggcctatacattatctcgtttaactctcttaacaccatggtaaggttgactgtatcataatctccatttatcagataaggaaacaaagattcagagaagtcaccaagttgagatcattgcccagctgcacacagctagtgagtggtgaagctgagacacaaatcagggcttccgacgccactttctattacactttactatgctgtgcattcgtgtaaaagcatgatatttttaaagtggcattccagctgccagaaggatatcaaatcaagtactaaagacaatattattagaaatggaaatctggactcaccaagaaatgtcttcagttctatataataggaagactggtattttgcttgatatgggtgtttcaatatcatctgctcctaaaatgcagtctagacacctcttgtgacctgctcaggtgatactaatgaagtttgggtcatttttagcatctacagagaacagagtaagagtgctgtgtgttcaatactattgcagacttatgggataaactggattttcttgctttactttataaagctaatgcctgattacaaatataagtttaaaacaaacctcaaaatttcttggcacccactctttgtggttggtaacatggacatctgtataaaatacccaagaccttcatagagcaaaagtgagtgggaaattaatttttattgggtatataatcatcactagccatgttcaaatactttttctctaaatcctttacaaagatcttgtaagttgggtattattacattcagtttagactaaacgaaatgcaaaaaaaaaaaataataaagaaaatagactcacaaggtaaagttgcatacttgagacataacaaaattaaatttcattctatgatgctgccacatagcagatgatacaagcagtatagaatacccataaacattatgttttaaggtatttccacctgtatctttcttggggcaggtaaatgaaactcactataaaccagttacaggtcctcctttatctgaggttttgctttctgaagtttcagttacctgcagtcaaccatggtctaaaaatattaaatgaaaaattccagaaataaacagtttattacgttttaaaatggatgtccttctgagttgtgtgatgaaatctcatgccatcctgctccatccctccagggatgtgagtcatccctttgtctagtgtatccatgctgtctgcccttagtcagccttcttggttgtcagattgattggtacaatggacacaaggtattaccgtgcttgtgtctaagtaacctgtgttttactattattacagtctattgttatagtttctattttaatataagttattgttggtaatctcttactgtgcttagctgataaattaaactttattatagatatctatctatatctatcacagatatatctatagatacgtacctgcgatatgtatctatatgcgatatgtatagatacatatcacaggtatgtatctatagatacatcggtatatatatgaaaaaacagtacatatagggtttggtactaaccacagtttcaggcatccactgggtggggatgcgggtcttaaaacacaacccttgtggataagagaggactactatatggaaagtcagagttagagagcttttgtaggttatgtagttcaatcttttgttttgctggtaaggagaagaatacaccttaattttgacttcttaactcgaaaagttaagaaacttgtctaaggtcacagagctagtggcagagcaagccaagcatcagtgtctccaaaatccagctcagtgttgtttgtgttatatcagaatgagtaagagttaagataagaacatgagtcttacagctccactatccatgttcaaattcttgctgaatgattggggaaacttacccaacctctctggacctcaggttattcacaagtaatacgaatataacagtatttgatagagccaattaaatgagttaatatttgcaaaatgctgaaatcagtgcttgccccataatgaatactcaataggtatttagatatttttattcttatctttcctcccaagcccaacctagtgtagaaacttctggaatggttgaattgaaggagaaatagtataaacagtataaaaaggtaaactttttaaaaagagaatcatgaagtagtgcttctacagagattgggggatggcaaacaacccatggagtaaattcacaagacttgacacttaagaatccaagagggctgcatgagatgagtccaggtaggcctcgtagacaaatcttagatggagttaactcaggaagccaaggagtatgagccagtagtcatcctgagcaaggataataatttttctttctgcctgccttcttgccttcttgtctccttgcctaccttccttcctttcttccagctttccctccctcttttccttccttccctatctccatccctcccttcctttcctacctccctcccttctttcttcttccctttcctccttctttccttccttcatttcttccttctttcctttcttcctccctctctcctacccttcttccttgcttccttcctccctccctcccctcccttccttccttttccttccttcctttccttccctccttcttcctccctctctccctccttccctacttccctccctcctactttcttctgtttcctctttccttcctctcttcttctttcctccctctcttccttccctccctcccaccttcctccctttcctcttccttcctctttcttccttctttccttcctccctcccatctccttccttccttccttctttctttccttcattcctccctccctcccttccttttttctctacctccctccctccttccttcttccttttcctccttctttcctttcctttctccttccttccctccctcccttcctgccttccacccttcctaccttcctgccttcctgcctgacttcctttcttccctcccccttccttctttcttgccttcctgccttgcagtcaccgaatgttttttgagtgactatgatgtgccaagacccggtataagggtgcacgaaataaagtctctaccctcaggagcttacttcctagtgggggagacagattataaacaaagacacaaataggtaatatactattatgtggtgaaaaatgctacgaagggaaagtcacagggagcatttttgtttggtttttttttgttgttttatatagaatggtcacaggtgcctctctgaggagcccttggagcagacacctgaatgaagtgaagccacatgcctggagaacaaatattcagactgagataagagtgaacacacacctgcagtgagagagagagagagttgggtgtgatttgcagacctgtaggaaggccagtgtggttgggcagagggagcagggaatgtaggcaggggccagatcacccagtatttgtaaactgaggcatggactgaatgatagggcggcttcattcatccaccaaaccacgtgctgagtaatctaccccaattccaaagcatgaacttgacaactgcttcttcatagtaatagatgaaggataaaaaaatttaaaaagcatatagatgagccaacttttatgtgcttaaagtgaaaacaatcatgtctataagacaaaagaaggaaagacatttgacatgctccatgtacctgagattcatctcgtgttaataaaatgttgaacatattacactattggccggtgtttagtttcagctgaggaactaattcctaaagctgcagcctgggggatggggagatagggtggacactgagacagggcatggaggaattcagatggtatttaccccagaaatatttactgaaattgggaatgctgagtcaagcctagccatgctagagggccttgggaaggcagttactagaatctccttgatttttttccaatttcagaagaagcaacaagaagaaagtgtcttgactaatccttctagtgaaagatattcacttttataataaggtgcttgtctacacagaggtttctgagtcaaaggaggagaacgtacaaaatagaccgaaagaagagcctgcctagctgctctttttcttttgtaattaccaagatcccgacggtttatacccactcaactgcaggtgctgggagaggagaggctactgtgacaaaaattatataaagaagagcccagcagatgcatttccagataaacaatgtaaaacatagtctatgtaagtgccataaaatttcactaataaaaaacacacatggctcagggaaacatttattatcaaaatggaagcaggaaagggcatatgctaagtcttattcatttcaataaatagcagaacgtgaattgataaaagttcttaattgaaaaacagttgctcatttgtagtttgatatttaaaagctttctaaacatgtatttattttgttttgccttgaagtaattagctattagactaactattttcttttcatgtcaggtacacagtggctccaaagtcaaaacaaggttagattggaaggaagcaaacaatgaaattgaagggaaatatcgacacttctcaatcaatgaaaatgcatcagcatgtatgagcatctttagctggcaataatacatcagaaataaataatgttagcaaaagagacagcatcattggctattcatagtatgtattcacggttgtacaataaaattctaaaggctgaggttgaaagtgaataaaaattattagttctaaacacttgaaaattccagcagcttagacatatttttgtatgctttcagtgccccaaatgtaaaacttaaatcattttatgaaaaaaccttgttcaatcttttaagaaatttgcatttcattgcaaagatggaacatagcatccttggctgagttattttctatagaagtcagtgccattttgtggtatatgattagcacattctaaaggcaaagattccagaacgtttaaatttagttgtgaaaaactgaaggcatttatccattcatatataagcatgaaaatgcaagcttcactttctcagtatgtttaaatgccacatattataatgggaattctagaagatgtgatcatcaaactctgatttcacgcttagaaatcaaataaaaaagagactggcctataattagaaaattagtcaagtcagatctaatatcaacacatggttgtcacagaacaaaaaatttttgctttgagaaaaatgagatatcattctggatgaatattctgggtcagtagaaaatagggaatcaaagtatagaaataaagtgtttatgtcactgtaaaacttctagttttctaaaataaaatttaaatatctgaaatagcagtttatacttcatactcatacagtcaatagacattggtagcttaagaaagaacttggtaagtgatgatttaaagagtgatatagattcagtagtattcaatatacagttgtaattgatgagctcatcaaactatggaatttgggatatttacataatatttacattatataatatgggagagatagcaagtatctataaagagtttaaattcccatactaggaaatgtatagtttgttttaatctatgtctacatttaaagtagatttttttttcagagacagcatatagttgggtattgctttttaaatttttaaatctaatctttgtcttttaaattatatttaacgtagttgttgatatggttgaatttatgtctattaccttgctacttgttttctatttatcccatttattcttgtttttttccctcaatgtctgccttcttttggattatttgttttagtattccattttatttccattagtggtttattagttatacctccttttaaatttatttacctaattttagttggtgccacaaggcttaaagtataaatctgtagtttatttttggaggatctttgccccacagattccagtcttaccatgctatttattttttagcgatttgattacgctctggtcaatatgtgattatgtgcaaactgtgtgtgtgtgcgtgtgtgtgtttatcttgcttgaggtttgttgaatttcttggatctgtgggcttagagtactcacataaaacttaaaataaatttctatattcttttttctggtatactgtctatgcactcttaattcatatagtcatgtttttatgtcagatattccattttttgtctttaaataatataccaattaatgtataacgtgatccttacaatagttatacttctatttccccatttttcctgctattgtgataatacattttacttctatatatgacaaaaaaccccatgatatacataacagtgtatataataataacatatttttgctttaaatagctaagtcttttaaataaatttttaaaacgagggccgggcgcggtggctcacacctgtaatcccagcattttgggaggccgagacaggcagatcatgaggtcaggagattgagaacatcctggctaacacggtgaaacccatctctactaaaaatgcaaaaaattagccaggcgtggtggcgggcgcctgtagtcccagctactcgggaggctgaggcaggagaatggcgtgaacccgggaggcggagcttgcagtgagctgagattgcgccactgcactctagcctgggcaacagagcgagactctgtctcaaaaaaaagaaatttttttttaaatgagaaaaagtattttatatttatccataaatttaccacttacatcacttcatttctttgtgtagacctgagtttttatgtggtatcattttctattttttaattaattaatttttttttgagatggagtctcgctctgtcgcccaggctggagtgcagtggcgcaatcttggctcactgcaacccccgcctcccgggttcaagcaattctcctgcctcagcctcccaagaagctgggactacaggtgcatgccaccatgcccagctaattttttttttgtatttttagtagagacggggtttcaccatgttagccaggatggtctcgatctcctgaactcgtgatccacccgcctcggcctcccaaagtgctgggattacaggcgtgagccactgcgcccagctatctttctctggttttcatagtttatggcaagaaacctgcagaatttcttacctttgttactttgtgaagtgtcttttttctctggatgcttttagattttttttttttagcaatttaattatgctgtggttaatatgtgtaattatgtgtaagctgcatatgtgtgtatgtgtgtgcgtgcgcttatcttgcttgaggtttgttgaatttcttggatctgtgggtttgtagtcacaccaaatttacataatttggtagccattatttcttgagatattatcccccatccattttttaatgtgtccttttttcccccaaatatacatgttagactgcttgatattattccacaggtcacttaggctctgctaattttttcactactctttttttctacatacttcattttggatgattctcttactatgtcttcaagttcatgggctttttcttttaatccaaatggtcacattttcatgtcagatattcttaatccaaatagtcacgttttcatgtcagatattctgttttatttttgtctgtagaaatcacatttgggctttaaaaaatatcctcaatttctctcctcatttcatgttttcctttaaatacttgcaaataggtttttttgtttgtttgtttgttttgagacggagtctcgctctgtcccccaggctggagtgcagtggcgcaatctcggctcactgcaagctccgcctcccaggtacccgccattctcctacctcagcctcccgagtagctgggactacaggcacccgccaccacgcccagctaatttttcattttcgtatttttagtagagacggggtttcaccgtgttagccaggatggtctagatctcctgacctcgtgatctgcccgcctcggcctcccgaagtgctgggattacaggtgtgagccaccgcgcccggccgcacataggtattttaacattcttgtatgctagttccattatctctgtcatttctgaatctatttctatttaatgcttttttcctcctcataatatgtcacattttcttgtatcttgtctagtaatttttgatagaatgctgaagattataaatgccaggtcatctggattttgacttccttaaaaaatattaattttggttttggcaggaagccaaacaaaaatccagatctaaagtccaagtttctagatatttgcccctcagcttctagcctgagcctctccaaactccagtctctgtcttctgagtcagccaggaagtaaatccaagctgttttgggttacccttccctctgcttatggaccataaattgcctcctggaagaaacctggggcaattgtagaaatcactttttttgtcttcttcctctcagagatcacagccctaagctgcctacaatctgatgtttgaaaacagctgcaccatatattttgttcagttaaattttttttttttaggccaggcatggtggctcatatctgtaatcccagcactttgggaggctgaggagggaggactgcttgagctcaggagtttgagaccagcctaggcaacatagtgagactctgtctctactaaaaataaaaaaaattagctgggcatggtggcacatgcctgtggtcccagctactcaggagccatctcaccgcagcctcgaattcctggcctcaagcgatcctcccacctcagcctcctaaagtgctgggattacaggcaaacaccactatgcccggctattgttcagtttttttttcttttgttttttgttgtttgcttttgcttttttgaggcagagtctcactctgtcgcccaggctggagtgcaatggcacgatgtcagctcactgcaacatccgcctcctgggttcaagggattctgctgcctcagcctcccgagtagctgcaactacaggcgcataccaccacgcctggctcatttttgtatttttagtggagacggggtttcaccatgttggccaggctggtctcaaactcctgacctcaggtgacccacccgccttggcctcccaaagtgctgggattacaggcgtgagccactgtgcccagcatattgttcagtttttaatgggaggttagggacaaattttgatactccattaacagcccaaagcctatttcccaaatctgttttagatacccttagatgaaataattcttacagaaaccatgagaccttaaatgattaatcataattatcaaagaaaactcctgagcagttaatgtcaaatgtaatatgatgtaagtaagttgattgataatattcgtgtcttgttaaaagaggctactttagtctgctgagatactgaacggattttcctaagggaaggagtatctgatatgaaataccagttaatcatcagtcaccaaccattaattaaatggctactttataaaggacattaaactgagcgctagatggagtatgttgttgcagtcatttcatagaaaagtctacaggggtaattataagaaaaagaaattgggtatttcaaagatctagtcactgatataagtggaatgtgatatcaaatgtgaatcaatactttaaaataatttttattaaatgcttattagatacagaagaatgctataaaaatatatgtaaacttaaaagtagtgcttctgaaactttaatgtgcaaacaaatcacctgagatcttgttaagatgcagattctgattcaggagtctggggtggggcctacctctgtagttctaaaaaaaaaaaatccaggtgaggacaatgtttctgctctgcagactatctttggagtagcaagagtaagagaagtgaaactacaatgatcatctgtgtgcccaccactggtgtaagaaaaataactttatttttatctctaatgtcttctgggtaccccctcctgatcccttccctccctcttagaaatgactacttccctccctcttagaaatgactactctcttgaattttgtttttatcatccttttgcttttcttaaaagttttaacacatttgcttgtcacttcaatatatattgttagggtttgcatatttttgaatgcatgaacctaatataaatggaatcatttgcatatatccttcttcaatttttcataccacattatgttcctgaggttaattcatatcattgtaatcatagtttgtataaacttaatttattttcatcactgtatggaattctattgtatgaatatacataattcattttaccgttgttgaattttgaaatttaggttttatactgccatgaaaattcttgcataagttcctggtgcacacatgcaacacttagtcagattatatacataggtgatgaattgctggctcataaggtatacacattttaaactttagtagattatgccaaattgttttctagagtggttatattgacttgttctgccaccaactgtgtgtacaaatgttctggttgttcctcatctgtattagttttatattgctgcacagcaaattgtcacaaatttactggcttaaaacaatatccacatattagatcatagctctataggtcagaaatccaggtgggcctggatgggttctctacttggggtctcaccagtctaaaatcaaagtttcagctgggctgactcttatctagaggcgctgtggaaaaatctgcttccaggctttttcaggctgttggaaacattcagttattggcagttacagactgaagccccttttcctgctgtctgttagctgctaaggaccactctcagctcctggaggccactctcagatccttgtcccatagccccctccacttatcaatggagaccctcctttgcatcaaattcctctcatgcttaaaatctctctgagttggataaaagtcaatatataaagagctaatgtgattagattaagcatatccaggcaatctcccttttgtcatataatgcaccatagtcacaagaataattccagcgattaaagttatgagggtcatctatagaattctgcctactctagtttactgatagccagactggccccatgattcactactgtttcataggtaaaatatattcaccacttcccaaggttcctagtgctttgattccattacagcatcagttcaaagtctaaaatctcaataaatcatctgaataatctaaaccagatggaatataaaaaggagtcagcaatccaaagcagtgttgaaatccagtggagcaaaactggttgggaaaactccactgagtttcaaggcctgggaataattctctttagctctcagctcctccctctccacttttggtttcaccctctgagtcaactttcttttttcataaagagtagatgaatagttttatctccctgcttctcgcagtagaatttgagcagatgtaagagtctcttttcattttatactctctctgtcccttttggtccagctggtagtatttctgctgatacaattttctcaagaactttctggatctcctgtggatatcacagtgattcactgcatcatacagaacacatgctgacaagtcttttgagataatcccttctctatttttggcttctactgaaatggttgagggacagaacccttaagcccagaggtcctctggtttaactgagaagatctgtgagaaacacccttaatctcctggaagggtagtttgtgtggtaaaatactctggccttttgatatttctgagttttcaacaaagaactgtatagtatacactcagacttttctttatgccactgttttagcagccatttatgacttttagcatccttttgccatctggagaggctgtgaattttctaaattatctactctggtttctgtttaaaagttcttccctcaatttatctctctcctttcacaatttactataagcaacaaggagaaatcaggctgtagctttaacacctttcttggaaatctccttagctatatattaaagttcattgtttacaaattctgctttccacataactgcaagatgcaactttgctagctatttggccactacataacaagactctcccttcctgcatttctaataatatgtttctcacttctttcttagtccgcactgacagcattctcaaagcccagatttttttaacctatttccttatattttaatgggttttctgtggctcatggtggctcatgcctgtaataccagcactttaggaggctgagtcaggaggactgcttgaacccaggagtttaagaccagcctgggcaacatagtgagaccccaacactgcaaaaaattaaaaaaattagctgggcatggtggtgtgtgcctatagtctcagctacctgggaggctgaggtagaaggattgcttgagcttgggaggtcaaggctgcagtgaactatgattgtgccactgtacttcaacctgggtgacaaagtgagactgtctcaatcaatcaatgaatagataaacaaaaaatgaatggaagttcttgtagacaaatatatgtggtttggcttttatttatccaatatgacaagccctaaattttattttatttattattttattttgagacagtctcactctgttgcccaggttggaatgcagtggtgacatcgtggctcactgcagcctcaacctcttgggctcaagtggtcttcccacctcagcttcctaaatagctggaactacagttatgtaccactgctcctggctaattaaaaaatttttttttgcagagaagagatcttgctatattgaccatactgaagccttgctttttaagatgatatttagatcatttacatttaatgtaattatcaatatttttagtttagtttcccaactttctatgtctttttatccaatttattttctcttcttttccttattcctgcgttttttgataagtatttttatgattacattttatttttcaggattggattattagttacacatttttgttttattatttttagtggttgctctagggtttacattattcatcttaacaaataacaccctacttcaaataatataataatatatattatttcacatatagtataaaactcataacttccattttcctcttttatcctttgaatgatactattgtctttcattttacttctaagatgttgtaaacctctcaacaaattgtttacatattttctttagacattcaattatcttttaaaatctttaaaaataagtaagaaaacatgtctcatatttatctacacttttaacatttccagtgctcctcatttctttgtgtaaatcccaatttctatgtagtgtcatttgtactgcctgaagaattccctctaatgtttcatttagcacagatctgccatcaattcatgttctctgcttttgtttgtctgaaaaagccttttttccttcagctctgagatattttttgctggttatagaattcagagttgacagttcttttttcttttagcactttaaaatgctattccattgttttttggcttacttatttttaacaagaagtttgtaataattcttttgttgttctgtgtataatatttctatttttttggctgtatgaaagattttctctttatctttggttttaagcaatttgtctatgatatgtcaaacagtgtttttaaaatattaattctgcttggtgttctctgtggtctgttatctttattaattttagaaattctcagtcattacctgttcaggcatttcttctgtgcatttctctctctttcctttttctacatgttaaaccaggtgatattttaccacagcttgtggatgctctgctcttgtttttctcattttttgtctctttgtattttagtttagataatttttattgtcttatcttcaagtcctctgacatattcttcttctgtgttcaagctgataatgagcccatcaaaggaattcttcatctctgatatattcttccttcatagcattcccattggacttttaatgactttctctctactgaaatttcccaacttttaatgtttgttgtgtatctcttctactggatcttttgttttgttttgtttttggagacagggtcttgctctgtcacccagcctggagtgcagtgatataatcatgggtcactgcagccttgacctaccaggctcaagctatccttccacttcagcctcttgaatagctgggactacaggtgtgtatcaccacacctggatttttattttattttatttttgtagagacagggccttgttatgttgcacagactgttcttgatctcctgggctcaagtgatcctcctgccttggcctccgaaagtgcttagattataggcatgagccaccatggctggctgaccttttaagactagagtcatagttattttgaagcccatgtctaatatttttacctgggccattcttaagtataatttttttgatgtttttatcctttgaaatgagtaattttgttcttgctttttgggctgtatcatattttttattgaattccagaattggtataaaagtatagtagaatgcgatttaaatagtattttcattaaaaatggatacacatgtttttgtgtcaagtaaacattcagaatcttaaagaaaaattgattaatttattctcagaaatgtgatatatagcatacaagataagaagtttgagcaataaataggtcaaaattgtgctgatgaacttcattaaaattttaacttcattaaaaattaaaattttaacttccttaaaaattaaaaataaaatatgtaattcaggaacatatatttctaaagtatcccattatactgaatattttagagtaacagttacaatggtatgtacatggcaagtaaaacagattttgaccttttcttgcaatagtagcaaaataataacaacaacaacataaaaaatcataatggtaaagtagcttatttacaaagtgaccaggagtaacattttatacccactctcacatgtaaagtgataagtggtacagaaaatgtattcagtgggaaatgtgggagagggtactccagagatagcagggagttataatggtctaggtctggacaatcacagcatcatatccctggattataatgattgatttgggaccggtcacagaactcaaacaaagactattagctctaacaagagctgttttgggaccctttgcagttagaactaaagttgtaaaaagataagactagattgacttggtgccattatgtcaccccaaagggtgagcctgaattaaaacagccaaaacacagaaaaatggagtgatggacagcaataagtttctgataatattatttaagtctttggattgagctatgcctaaagatctttttcagttataagaaccagcaaatgattttttcctatttttaaatgtaatttaattatttatctatgtttaaatcaacagataaaattgtatgtatttattgcatgcaacatgatgttttgaagcatgtatacattgtgaaatgactaagtataattaacatgtgcattatctcacagttatttttgtggtgagaacactttacttatactttcagcattttataagaatacaatatattaactatagtcaccacgttgtacaagggatctcttaaacttattcctcctatctaactgaaaatttgttatcttttgatcaacatctccccaattccctccttgcaatcaccttatcccctagtaatcaccattctactctctacttctatgagatcaacttttttagattccatatggtgagatcatgcagtatttatctttctgtgcctttcttaattcacttaacataatgtccttgaggtttatccatgctgttgcaaatgacaggatttcccttatttttttatggacaaatagtactccattgtgtatatgtaacatttttcttatccattcatccatgatgaacacttaggttgattccatatcttggtgattgtgaatactgctgcaatgaacaccaaagtgcagatatctgttttagatgctgattttatttcctttggatattatctcagtggtgggattattagatcacatggtacttatatttttaattttttgagaaacctccatactgttttccatggctgtattaatttacattctctccaacagtgtacagggttctcttttctccaaatcctcactaacacttgctatcttttgtctttttgataatagccattctaacaggtatgaagtgatatctccttatggttttgatttgaatttccctgatgattagtgatgttgagcaccttttcatatacttcttggccattttgtatatgttctttggagaaatgtcaattcagatcctttgcctatttttaaattggggctttgctgtgtttttgttttgctattgagttaactgaattccttatatgttttggaatattaactccttatcagatgtatagtttgcaaatattttctcacactctgtaggttgtcttttcactctgttgattttttcctttgatttgcagctgctttgtagtttgatataatcccagttatctatcttgcctttgttgcctgggcttttggttcatgttaaaaaaaataattgcctagaccaatgtcatggagctttctcctatgttttcttctagaagtttcatagttttgggtctaacatttatggctttcatccattttgagttgatttttatatatggtaggagataaggatccaatttcattcttctgcatttggatatccagttttcccaacaccatttattgaagagactgtcctttcctcagtgtgccttcttggtacctttgtgaaaaatcagctgactgtaaatgtgttaatttatttctgtgtactttattttgttccattggtttacgtgtctatttttatgccagtaccaggctgttttggttactgttattttgtagtatattttgaaatcaggtagtatgatggctccaaatttgtttgcttgtttgttttgctcatgattgctttgtctatttgggaccttttttgatttcatatcaattttaggattgttttttctgtttctgtgaagaatgagccaggcacggtggcttgctcctgtagtcccagcactttgggaggccaaggtgggaggatcatttgaacccaggattttgaaaaattagctgggtgcaatggcatgtagctgtcattcaggctgctcgggaggctgaggcaggaggatcctttgagcccaggagttcaagacagcagtgagctatgattgtgccactgcattgcagcctaggtgacaaaacaagaccccatctcttaagaaaggaagaaggaaagaaagaaagaaagagaaagaaagagaaagaaggaaaagaaggaaagaaaataaaaaaaagaaaggagggagggaggaaggagacagagaaaggaagaaagaaagaaagaaaaagaaagaaaaacagaaagaaaaagaaagaaagtcattggtattttggtagagattgcattgaatgtatagattgctttggataatgtggacattttaacaatattaattcttccaatccatgtgcatgagatctctttctatttgtgtcttcttcaatttctttcatcagtgttttatggtttttggtgcagagatcttttacctccttggttaaatttatttctaaatattttttgtagctattgtaattaggattattttcctaatttcctcttcagatagcttgctttttgggtacggaaacgctactgattttttttttcccaacaaatgatttttaacttagacaaatttacactgggttttatctcctttcaaaaaaatgaggctgatggaaaattcaagagtcaatgttttttttctaagagagaaacagaaaaataaataacctggcattagggtgtagtatggcctggagaaaagagatgctggagatcagcacagcagcaagagtcaggatgataaagagagagagagagagaaaaaaaaaaaaacactaagtaaccaaagataaagtactgagtgggaaaatattacttccaataagggaatctgatccagcacaaagtctgggctctggaggaaagaggcatgagaaagaaaaatataggatagctctttttaagtcaaagacatgaactgtttactccaaattagggcagtgaagacctgagttgcagactgtctggtgatatcttgcctttctgttaggtaagcactagggtggctgagctgagctgctgcaaatgtgacataaccggtttgggactatggtgtgcacctgcttgcgctatatgcatggcatgacccaattgagattatggtgtctttagttggcttgtcctagtggcagcaggtgaggtatccagatctgcacctgaaccgaggtatttgaataagtgatagaggagcaattcaaaaggcttttctgaaagtaagtcagtgagactggttgtgtgatggatgagggacctcaggaagagagaggagtaaatactgatgccaaggatgctagcttggactctggatgaacactgacatgtgtgactttgagtttaacaattgctaaactgtgatcaaaattatgggaggcattacactgaaaggcaaaactcaaagaaaactctaatatagtattagttgaaaagtaaatgggggtaccatgaagataactaaagccatatttggtatacatttaaaatgctagaatatgtcctttggatgtgctgtttgcatatagggtacacagaaggggacttttatcttgttaggttttatttcagatatataatggctctttttgttcccagtgaatttgggatgttctatgtgttgcttaatagtaaaatatttaaatgttaaattattagtatgcaatatgtgttagtataaatcaagtactttcattgaatctctgaagataaatacaaccatgtaatgtttaattttgactgtcttgcaaacgacctgaacatcaattaacaatctaataataatagtaactaacagtttttcatgctcaggcactattctaagtgctacacaatctggtaacctatttaatgttcacaactaccctacgaagcaggtacaattagttctcccatttactgatgaggaaaccaaatcactgggaagttaacttgctgaagtcgcatagctagtaaatagtagaaaccaatattagattctaggcagtctgattccagcgcttaaactcaaacactcatctttactggctacatgttgtatattcacatacacacacacaaaatttaacaaaacacttataaacaaagtactgtgagatctatagataagaacatccagtcttgctgttaggaaatgtggctgggaaaatagaatatttatatgaaaaagataataatagaagacagtgtgtaggaagtgacagatggatggcacagacaaatcactctgcagaggttgtagagaatggggcaggggtaggttacaggacagatggtcttaaactgatggataggacctacctgtaccatctggttcctgcccacctctctaaacttatcttcctgacattcaccaaattctagccacacggaccttctttgtgttcctcaaaatgccacactcttttctgtcccacggcttttacaattgttgtgtcttctgcctggaagactctttctttaaatcttggcaaggctgcctcctttattattcagaagtcagatcattgtgccctctgatatggtttggctctctgttcccatgcaaatctcatctcaaattttaatcccacatgtccagggagggacctgtaatccccatgtgtcaagggagggaggtgattggatcctgggggtgatttccctcatgctgttcttgtgatagtgagttctcctgagatctgatggttttataagtgtttggaagttctttcttcactcttctctgtgctgctgccttgtgaggaaggtgcctgcttccccttcgccttctgctatgattgtaagtttcctgaggtttccccagccatgcagaactgtgagtcaattaaacgtctttcctttataaattacccagtctcaggtagtatcttttagcagtgtgagaatggactactacaccctccttaatgagaacttccttggtgacccaaactgaaatactgcttcactcctaccccagtccactagcctgtttgatttcattcatgacactttccttacctgaaattatctacttgctaacctgcttatggtctgtttctcttcactagaatgaaagctccacgagcaaggatctatgatgcctgtcttgttctcatcttttttattttttccctcaagtagtttctgaagtttctacctcatctacacaatctttctgggctttaaaggctatgagggaatgtccctctttgacttgttttgaagccttgggcctacttatttgtatataagagaatatttttaaatggttctcttctttatatatttaaagcatgaaatgctctgaatatcaatgaacccaatcacatttgggtaatagaaaaggctgttttcttcatagttgattctttttttaaaaatttaatttcttatttatttattttgagagagagtctcattccattgcccaggctgaagtgcagtggcatgatctcagctcactgaaacctccacctcccaggttccagcgattcatacacctcagcctcctgagtagctggtattacagctgcacgccaccatgcctggctaattttttgtatttttagtagtgatggggtttcgctatgttggccaggctggtctccaattcctggcctcaagtgatccgcccgccttggcctcccaaagtgctgggattacaggcctgagccactgtgcccagcctgtagttggttcttttgaaatgttcctctcctttatgggccaagctgatagcatttgctttaccctctccatttcgtatatttatcagccatcaaaggcttttcttattgcttggaacttaattgaatgatgtttttgtttctttaccaacaaatgaacacaagcggctttcgaaaatactccaaaaaacagtgagctgtaggcaagattttattcttcatgtgtgatatattttggtaattaaggagtcaattctttggctaaatgctgaaagaaaaatgatgattattgtgtaggataaagctgtgaattatagaatactttcaactctgtttaaaatctaattaacattaattgttacattaattttccctgtgaaatttactaactgtatacaaaatgatatttaatcttcctaatggaggtctagtgtattcgtttcagtcctattcgtaggaatatgagttgaaatggcaaagttatagttatgttgaaagtaatgaagtaatttttatataaaactaatttattaactatcacattgtaattaattaaaacactcttacttttacacaatgttcctgtttttaaagtacttttgtgtgtgtgtgatatacatatctatatgtacatatatgtggattcccacagcgtcgtatgatacaagcagaaccattaattattatttatccccatacttatgtataatggagtttccatgaggtttaaaaacttcccctgtaacataaggatagtggatcatgaagttcataatttgtgaccttattaagttctaattactagggatacttcttgttttagtttgctagggctgccataacaaagcatcaagatttagtggttaggccaggtgcggtggctcatgcctgtaattccagcactttgggaggctgaggcaggtggatcacctgaggtcaagagctcaataccagcctggcccaacatggtgaaaccccgtctctactaaaaatacaaaaattagttgggcatggtggtgcgtgcctgtaatctcagctactcggaaggctgaggcaggagagaatcgcttgaacccaggaggcggaggttgcagtgagccaagatcgtaccactgcactccatcctgggtaaaagattgagtggcttaagtgatagaagtttcttttctcacagttttgggggttagaagtctaaggtcaaggtgtcggcagggctgactgcttctaaagcctctctccttggtttgcagacggctgccttctccctgtgttttcacacggacttccctctgagcatgtttatgtcccaatttcctctttcttataaggacaccagtcgtgttggattagggcctaccctaatgacctcgcttttgcttaatcacctctttgaagatcccatctccaaatacagtcacattctgaggtactggagattaggacttcaatttatgtattgttggaggataaaattcaaccataacgcttgtgtaaattgtgaagaaaacagtaattaatgtatagcttgttttaaattttctgagtgaatgagttaaagaggctatatgaaatagtaagtgctattttagccaagaaaattatgtctcagcacatgtggtttgtgtttcaaaaatatttcttgagtaaaatgtctgatttatctaatatttttaataatgctataacctttactattttgataatggtagtactacccgacatatattgagtcttaccatgtaccagactgttttaaacatatgccctgtattaacatatttaattattacaagcaacctatggaatactattattgccctaattttaaaaatatggaagctggccaggcatggtggttcacgcctgtaatcccagcactttgggaggccaaggcagatggatcacctgaggtcaggagttcaagaccagcctagccaacatggtgaaaccccatctctactaaaaaaaatttaaaaaattaaaaaaaagagagtaaactctgtgtaagaacgctaaatgacttgtcaaaggttctacggcaattaagtagcagaattggaatgaaacccaggttctcaggctctggaacttttgattagcaggccagtggttctcaatgggtggactctagtttctggctaagatggagtaagaggaaaagatttaccatccaatgtagaacaactaaaaaatgtatctaaatatgtaaaacaatggattgtaagacattggacttcatggaatgaaaggcagtgatccctgcgaggaaccatatagttgccccactttataatcgagagaaagagttcccaggcttgatgctcaggaaggtgatacctgacccctgcagcctgcagttggaacacagcactgagagtccagggagaccaatgcaatcagagtacagggaagaggacaagagtactctgcacagggagcgagaaagagcttcacagacagtcagagggttcccttgaatcatcagaggaaaacagattagtatatacatgtgcagaaactagccatggctggggaaagaactaccgaaggactagagggaacaattgctggaactcatctggggctggaatagttcctgtccccaaatcataactcatgggacattgggtagaatattcagaagaattttgactcggtggggaaaaattagccctacactaaattatgctagttccaccttaccaagcttaaaagaaagacctgaaagggtcaaactgtttccaagttgaagaggaaagggaataaacattcacgaattactgtcatcatcgtgaagggactctggatgtgaatcagtagctacacaagaaccttcagtgtctctgagcatgggaagatgaaaagatttgcttttcatgcaaggaatttaaatttccaatgtcatatatatgaggacaaaatacattagtgtctgagtgttcccagcacttctcctcttcaccccactgaaaagagtctatccacccagattcttcccctccacagctcttcagagagggttctgctggccagattggttcagaaagaaggtattaagaattaccagctgggtgtggtggctcacacctgtaatcccagcactttgggaggtcgaggcaggtggatcacgaggtcaggagatccagaccatcctggttaacatggtgaaaccccatctctactagaaatacaaaaattagctgggcatggtggtgggcgcctgtagtcccagctacttgggaggctgaggcaggagaatggcatgaacccgggaggcggagcttgcagtgagccaagatcccaccactgcactccagcctgggtgacagagcgagactctatctcaaaaaaaaaaaaaaaaaaaaaaaaaaaaagaattaccatgtgaatgatgaacacttcccagtgtttgttgataactgaagtaaagaccttgagatagtgttggaattactgtttggttgctgggtagtatttgtttacctctcacactactttcagatgggctatgttagtcatagctttaaccagattatagatttactgattggatagatgtttactaaaaattaagtgagcaaatgcaaggactagaacaacatagacaatatattctgatttttatttaaaagaaatatgcaaaaaacactataaaattttaccccaaatatacccatcagtataccaaaagtgtaccatgtatgctaacagccatataaaattactaaaaggatatataccaagctattggtaaaaggttatctctttcactggggaccaggattgggcaggtagaaggcagtaggaacatagcaaggagatcctttcactttgtattccgtatattgatgagttgcttgagttaaataaaacaagaattataatttgtcattaaaaaactaaatattaaaaattaccatcttcccagtgtttgcaatttttttttttttttttttgagacaagtcttgctgtcaccaggctggagtgcagtggcgtgatcttggctcactgcactctctgcctcctgggttcaagcggttctcctgcctcagcttcccaagtagctgggactacaggtgtgcccagttaattttttgtatttttagtagagatggggtttcaccatgttggccaggatggtctcgatctcttgacctcgtgatctgcctgcctcggcctctcaaagtgctggaattacaggcatgagccaccgcgcctggcccaggcttcaaaatttttaaacatttaactggaatagtaagtaaccaacaagcacttagaaagtgcctagtgtttatgattcctgccacctcagagagctacatttgtgttcaatcttcggacacttaaatgttttcaatgtatgtaaataattattgttaagattttcctaatttctttgttaaaatggttcatttcaaggttctttagagcttgcatttatttcattttttgtcatgtttcttttctcttagaataaaaaccagcagtcattttaattacccctgataatgttcatgaatactgccttggcctgtcttctggtttggaaccttttcaagggcgaatggatatttgtctggtgttccatgtataacctgtccttgtgccacttttccaatgtggcaggaagggaacaactgtcatctgttctgagaattcagcactgtgtctggcactgtgggaatttacccagactgctttgggggaagacatctgacacttcatgataattgtaattaaccagaaagacactggaattggaggatttgaagggaaatatgacaagggattaagactttgagattacttttggagccagggtgacttaagcacatttaaaaagttaggtttacttatatattattattatattctaaaccataagacattttctaataaggtttctaagaggaacatgtaaacctggatcaaatttaaataaggttactgaaaatattaatgaaaccaatgactgagcattttataaatgagaactgtattgctttaagttggagaaaagctgcaagtaagacaacatatttcttcatttgaaagcttgtgtccttatatgagggacattgacaaatgagtggtgataaaatggtggtctatgtgccataagggcttaggtacataaattaatgttttattaaccataaaaataaggttaaaaggttgaaatgtagccttcatgtgtctatgtaaaaaagaggcagaaaaaaatcctcagcactctagagaagcttagtctctgagcaatcactgcatatactaatatattcacatataatctagaatgaatgttaaataacaaaaatcatgttcgtttttatattttgctttgcctttgggatacgaagtgatggaacgagctcgttaacactgctcatttctggttagaagaacactagaaccacctagtggatttttcatttattgcatgatccctacactttactattgctaaattgttaattgctgagataggccttaaagtaaaatcagtggttataatctctttgtgggtcataatagaaatagtaattgttaatcttcagcagacaaagctgtccctaagtccttgaagggaagtccctgcccaccaaatacttaccaactagcacactgctgcatctagaaaagcacaggcagagttaaacatttggctgctgagatacaccgtgcaactggagctttaaatttcctgtgaaagtcagtgagcaaggtaaactgcagcaattcatctgcattcatggcagagtcaactttcggtgagcaagactagggaactctgcagagcacagccaaggggctacattagcagcttgacctttgtattcaatataaatctgtgggcacacaaactggcgtttctaatcaattttgtttttggagcaaagtagcttatgtggttacagcgtgccctggtcattctgtttcccattgctgaaccaactgggtctccgcatcttggtggtgatgacagatgttacgtatattacattgggatttgggtcagataaatagcaaatattctgggaaaggatactttatgtttttgcaaaaggttataaaataccaaactttagtaaaccctgattctaggccaaaggttaactctttatatctatgatttattaggtatcaaaagaaaaaagtcaggatctaaggggaatggaaaagtttctgctattctaacctaagagctggttgtcttctcctagtaaactaactgttcagcagatgggatgcatcgggctacaaggttggtgctttccagccggcaccgcgtgtgaagggcatgtggttgggctgggctctccaagtctgcatggcttgggttgactataaccaggggaaacacgcagtggctacaactgcttctcctaacaattctcgtttcattctcttctcccacagtgtgaaggaggctaggtggatattctctggggcttgaaatttcacactgcaaattttacgagagtgatgatctcttcctaactctttagaagccaagataggaaaaatttcagtttacaagaataaagcccaatccctcttcttatgttggaatgtccagtaaaatgctaagaaacgggtgggtagaagaagaggaaaggaagaagagaaacagagaggagagtaaggaaaaaatagaaaaggcagaaaaaaataatgtacatgaacaacaacaaaaatagtgacaaacagaatggactatagagataggggagggtagtgaagggcttcagagaagtcaggtgaagggccttcttttcttttctttttctttttcctttttttttttttttttttgagatggagttttgctctgtcatccaggctggagtgcagtggcataatctcagctcactgcaacctctccctccgggttcaagcaattctcttgcctcagcctcctgagtagctgggattacaggtgcccaccaccatgcctggctaatttttgtacttttagtagagacggggtttcaccatgttggccaggctggtctagaactcctggcctcaagtgatcctcctgccttggcctcccaaagtgctgggattacaggcatgagccaccgtgctcggccagggccttcttttttaaagaaaattttattatgctgtgataagaacacaacatgaggtctaccctcttaaaaattgtgtgcataatacaatactgttaactagaggcacaggttgtacagcagatccctagaatttattcatcttgcataactgaaacttcacccctgttgattagcaatttcccatccttgcaccccagtccttggtaaccaccatttattctactctcgcattatgtgaaatggactattctagatacctcctcaaagtgcaatcttgcagtatttgttcttctgtgactggcttatttcacttagcataatgtcatcaagtttcattcctattatatatgtcaacattttcttctttttaaaggctgaggctgagtaatattccgctgtgtgtgtgtgtgtgtgcgcgcgtgcatgtgtgtgtgtatataatattccaatttacgtattcatccattgatgaacattttggttatttccacatcttgttttttttgaatagtgctgcagtgaacagtgggatactaatatttctgagatcctgattttagttttttgtgtttattttttttgagacagggtctcgctctgttgcccgggctggagtggtggcgccatctcggctcactgctgcctcaatctcctgggctcaagtgatcttcccacgtcagtctcctgagtagctgggagtatagaccaccatgctcagctaatttttgtttattttttgtagagacgaggtctcactatgttgcccaggatgatctcaaactcttagactgaagcgatcctcctgtctcagcctcctaaagtgctgggaatataggcatgagccaccatgccaggccccagtttcagttattttagataaataccgaaaagtgggattgttggatcatctggtagttctatgttttcaatatttttaatttttcccagcttttttgaggtataattgacaaaaattgtatatatttgaggtatactatgtgataatttaagttgtgaaatgattaccacaatccagttaattgacacatctgtcatctcacataattaccatttgtgtgtgtgtggtgagaacatacaatatctactttctgagcaaatttcaagcatgcagtatggtattattaaccgtaattatcatgctgtactaatattggatccctagaacttaattcatcttacaacagaaagtttacatcctttgctcaacatctatttctcctacctctggatctctggtaaccaatttctactctctgtttctaagagttcaacttttttagatttcacatataagtagaatcagacagtatttatctttcttcatttggcttatttcttttagcatgatgtccttcagattcatccatgttgttgcaaatggcaggattttcttctttttttaaagactgaataagattttctttttatgcatacatattgtctttatccattcacctgtgatggacacttaggttgtttccataccttgactattacgaataatgctgcaatgaccatggggatacagatatttcttcaagatacttatttactttcctttggatatagacccagaagtgggattgattttattatatagcagtgttgttcttcactttttgaagaactgccatactattttccatagcaacagcaccattttgcattcccacaaacagtatgcaagggttccaatgtctccacaacttcaccaacacttttctcttttcctcggagctttttgtctgttaaaccccagcttcccccagcctgaagcatagttgacaaagattgtatatatttacagcgtacaacatggtgttttgatatatgcatacattgtaaaatgattcaatcaagctaattaacatagccgacacttcatgtacttatctctctttttttttttgtgatgagaacattggctttttgatagccatcctaatagatgtgaggtgatatctcattgtggttttgatttacagtttcctgattaggtgatgttgagcatcttttcacattcatgttggccatttgtatgtcttctttggaaaaatgtcttttcaggtcttgagccccgatttaattaggttattagtatttttgctcttgagttttaagagttccttgtatatttcagaaattaaccccttctccattacatagtttgcaaatgttttctcccattctatggtagtttttttcattctgttgtttcctttgctcacagaagcgttttagtctgatgtagtcccatttgcgtatttatgcttttgtcgctgtgctcttggtgtcatatctatgaaatccttgccaagatcaatgtcatgaagattttcccttatgctttctcccagtggtttcacagtttcaagtcttacatttaagtttttaatctacttggcattgatttttgtgtacagtgtaagatatggatccaaattcattcttttgcagttggagagccagttttctcaacactatttgttaaagaaaccatcttttgcccattgtatattcttggcacccttgtcaaagatcaattgatcatatatacgtgggtctatttctgggctcctgattctgttctattggtctatagtctgtctttatgccaataccaaagtgatttaattatggttgctctgtaatgcattttgaaatcaggaagtgtgatgcctctagctttgttctttctcaaaattattccggctactcaggggcttttgtatttccatataaattttagaattgttttgcctatttctataaaaaatgccatcgagattttaataggaattgcactgaatctatagattactttcggtagtgtggatacttccacaataataagtcttgcaatccatgaaccaggatgaagggcttctatatatagggcatcagttctcaagattggctgctgggcttctcagagcccatgaagataataatgagacactgttagttaattttaatattttaaagtttgatattctatcttttaacgtttacaggaatttgaaattgtatatttatgtgtgtacctatttgtttcatggctctatgaaggcaggaccatgtctcttttactcaccacagaacaactagcaccactgttgtgcagtagagcctgatggttagagctgcacgcatgggcagacctcccggtttgccatcctgctgcgaccactgactaccaatggcacatataccaccaattggctaggctaacaaacattccaagccccattttgccttgttgccttccattatagaggcttgtacaagaaaaaaaaccctacattttactttcccactctcatgctgctgggggatggtcaaaggacacagacttggccaatgaggggttagcagaaagctggcgaaggattctggaaaggctttgaattcctgctgaaaaggaaaaatgcagttgacagatgacactaccctctctcttcttaacttaaacgtggatgtgatgcttggatataggtccgccattctgtgcttctgagggaaagagtcagtcaattctcagagggagcagctctaacaccgtggagccatggaatgaacactaggaacaaatgacctcccagctgattgttatatgagagaaataaatgtccatttgtttcagccactgtacatagggctttctgttctttttcagcaaaacgctcctattacagcagttttgtgacttcaagcaagttactttactctgttttaatgttcccatttaaaaacagggattataccaatatcgtcctcatagggttgtttgaaagactaaatgagataatatacgtaaagagcacagagtaagcactagatagggataaattactatttttattactattttgatgatgggctcttaataagtcttagatgaataagtggagtaggtcaaacccaaagggtatggcttcaacccaaggcaacccaaggcaacccaagataactcatttttttctgtttgagaaaaatgagaaagggtggagaaatgagaggaaggtggggtgcggggaaggaggcagggctaaagtggagccaggtgggtgctgggtgggggggaaaatgccctatgaaaatctcccatggtgaatggtcaatgtgttggggccaacatattggccatgtgtggtccaggcatgccagtatcaacagacactaaataaacattttttttttttggctcattgaataaatgaatgcattgtgagggtgttcattaacaaagaaattgccatctcatccttaaaactgaagagatagaagtgagagggcagaaggtttttctccagtgtcactcgcacacctattataatatttgcctggaattatgtgggtgaagatgcattgctcaataattgcctgtgccctcgcaaggagcagaggagaacatccggtgggagcagaagcagaggcagaaagaacagatttcccacggagtaaaatattctgttctcataaaaagtcccttgctgtaacaaacgagaaaatgaaaaggagagcctgtagaagagaggcagacacctcttaataggcacatctctccaaagtttcccaccaggggccaactgttcattaaacagggaacaaatgcgggagcgtagctgtgatgggctccattccacagcccagtgctgggactgcagtgcgctaggaagggcgtcgctgttgttgctgtggcccggtgtgacagcaggtctggcatgtcagaatcgccctgcacaaatagctcctgtgcagctgctctcacccaaacctgctctgaggaggctcagtgcattctaatccttcctaaaaacatggacagaaagcaatggaaagttgacatgtataaaaggtttagtcatggggtttttaagtggatgcctccatgaaaggatcaactcagatggccacgtttctgaacattatttacatcaaaacctgacataaatgcctcagatctagctattttcttcctctatcctctttttacatgtctccttttccctctcgattgctttagcttgtaacctgcatgcgctttcaaatgtggtaagcaaatagaaagcaagacgccatttgaatagtgaatggacttgtattcctgtttaggaatgtgtagttgcccttgggctttctcagttataagactcataaaataaaaccttaacacagatggaacacacacacacacacgcacatgcaccacttaaagcagatgtgagtcaaaaacatatgctgatgaactcaatttgctgatggcattctgagcagtgagcccactcagtagggctgaagggttggcatagcaactcttcctgggaaaaaatagacagctggaataaaccatgacgatgaaagtcttcttccaatgactgaagaagtagagagaaattgccatctcttctaaccccttcaagcaaagcaccttggttgaggtttatagactaggatcttacaaattagaagttcatgtattttcctaggtcagattctataccttgggttatattccagctaagaaacactttcagataggctgcatggggctgtggggaaagagagagcacaaacctccaaaaagcatggagctttgaccaaagtttatttctgtaacttatcctaaggctatgccgagtgaagacttgtttactctagctgtaacttactccatcacatagcaccattactttgagaaattaacatattcattctcaattatttatcaagtatccagcactagcaatagggacacagtccctgcttttgagggattcatgactaggcagacagcaccctgagtatattaattaagatctgatcccatattagaataatatgcacaagagacttattacctctgtctcctcattcctataaacatttatctgggacctatcttatgtggactgtgctaggtgcaatgccaagggataaagcaagttaaatggcaacagtcctattcgacaggccagggactcaggatcagactcaggaccctttccctcttgttgcaaatcctgctatgtgtgggctcagccccaaactgtctctgaaatctcagaaatgagcaaaggctaaggatgtcaaattggctttgagatatgcctgtagactgataacaatagtgatgatgacgatgatattagttaatacaataaagctaatactgtgctattattaccaggcactgttctaagtactttaaataacttatttcatatactcttctgtcatttagtatgcataccattattctccttcccattatccatatgaggaaagcaaggcactgagttaaaacgactcacctttaactgttcatctatcaggtaagctaaccccggagcctacataaattcttaactattaaataagctatgccacttctcaaccactctgctgaaaactatacaaactgacaggtcctacaattaaaacccaaaatagatataataaagcataaaaaatcagttaggaattttctcttgcttttgctctgctgttattgttgttctccagataagtcccattttaaaatccacagtcaccttaaggatgtgatgtgggagctggagctgtctgcctacccaccagctatttttaaaggaagatgatcaggaactagttatgaaagaatcagattgtttaatctggtaccacagaacttgagaaactatagacttggtaagttggaaaatatgtaggcagaagtgatgtctctatggaaacagatgtgaagattcaagtaaatactaggcctgttggactttttatgaagatagcagaagcttttttccccacttcttcttctataacctgtttattgaggaatctgaccatggtgaggaacaagctagagacatatttttatctctagtcactgcttccaactctgctatgtcgaatctcccaactcttctagacatctctcaatgacatcttggacaggaaccatagtcacttacagtctagtccagccttatagcatatgcaactgcatatccagttcaagattttccattgctccattgatggctacacttattactcaaggatctactgtgggtgtgcttaggggtaactctttcaccttggagagtggtgtgggaatgttcttgttctagtatacttcatcccaaagacccaattcctcctgttttggggactgggagagaagatgagatggcttaatgtctcttggctttctctattgcttttgctgtctctctagcataccctagcgaccactgagactcttgtggggcagagatccacacgttatctatcttagggacatgatgggttcttcgaagtccctcatgagaggcgtgactctggctcaaacatgttcagcccccttcagctgtccaagcccccccaccctctatcagctctaactacactgcttgcatttttctttcctggtgggctgctttactggcatgtggaggagtgctgatatagcaggaagagttttgctacttcttattaagtcctgaaaaggtatctggtgggtgctgtgtttgtaataagatacttagcacctgtttcccctcgagctttgggcctaggtatcagttctcagacaaaaggaaaagtcaatttttataccctattataatgataaactttgattgaaactttggggataagaaagcatcgagatgtttctctctccttctattcctcttttctcctccctccctctctccctccttcctttgctcccttctttccttcctttctttcttccaaatagcaaccatgtaatctaaattatgaatgataaaaaagcctggcaaatcaatgagagaacttagagcaaaggaatttggaatattataagatagggaacaattttagtttcctgagcattttggttgtattaccacctgctccaatcatagactgtactttttcatgcccagaaaagacttctacaacccagccttcatagcaatcagccactcgggactttcttgcagtctgagctcaacctgtcttattttgctctgagttttccagttctgaaggcttgattactggtccaagagtgtcatttaggtagatatgctgaactcacatcatcctcgttacaaattgttatggaaaatcccaaaaatataaaagaaaaaaattttaaaaactagctaagggcactgttcacatgctgcaagatctcacggaggagaagatggaatgagtggaggatacacttgctgtgtgttcatcattgaagaagggaaagagcttgtgaaatgacccctagcagaaactcactggtgctttcaagttcagggtggcagggttgaaggtgagagttagcttcagggaagatggtggagaagaatgtttgctagtatctggaccccaaaggattacacaggatgctggagcctgcatgggctaggaataccattagttcaatcatggtctacacttggcaaggaagatgcattgagaataggtgaagggcatagtcaagaccaatgctaactgtcattccttatggaggaattatggaatctacttcaggctgccatgaaaagcaaagcagagaatctgttgggacaactcgttcagcagcctcagactacagctgcatctttacttatctaggcctctagatcactcagaagtaaaggaaaatttaaacaaatctaaacattctcattctttcactggggtcttcaaagttttgaacacaatctctcagaagaatcaatttctgatacctgaatctttgtaagcacgaacagagagaagggactggacagatgaaaaggatttgtagttcaaagaagagggccattgtggggaactgatgctgagctctcggttctatgccccccagacttccttcttcagttacggtccctgcagaatcagcatccatctgcgactctcctttattcattgaactccttgttttggagaggagaggcatattttctactttatgtagctctccagcccatgatctcctgtggtcaggggctaaggattcctttccctgtttcctagtaatgcataactctatctctccataaggcagggtgggccaggcattcagaaagttggggaagctaggcagaatgtgaaataagtgaagggaattgaagggtgctggaaaacctcccatcaaaatttcctcccccatgttattccaccattaggtaattagctccctggttcttaaaggattacatcacttttctttgttaagagttgagtcatctatgcaaaaaaaaaaaaacaaacaaaaaacccaaaaactgagtgaattaaaaccagaatccttattagttattacctcaggagctttaacagtgtcccacttcaattagagcaaagctcactgggaatgtgtgtaggataaagaagatgttggaggtaatagacattaaggaaggggccaggagcgtggagggaacccaagagacgtgggaggatctcaaaagtgatctttgcctattgccaactgtgactgaggccctggcccatcatttgatgttctctgtcattcttgggagaggcagaggagtgtgatgattaagagcatggactctaaagctagacttctgggttcataaagggtaacagcttagctctgccccttcctaccttggggactttgagcaaataatttaaccgctctgtgcttttttcttcatttataaaacaggagtaatattggtccctgcctcaaagggttgttgtgaggattaaaggagttaacacacataaaatacttagaagagcacatggcatagagtaaatgctagttgttattagtatgctttcaatttcacaaagggacttaaaaggtcagaacccttacttactcctaggaaccactggggaaggagtgaggaccaacatatattgcatatgtatgccccagatactgtatataaaatatctcattgaaacctcacatattgatgaaataggtattacaatatccctattttgcaggtgagaaaactgtgtctcagagggtgagaatctggcccaaggtaatacagctaaaaagtggtaaagttatctatgatatcccacaatgttacttacacagttctctttggaaataaaaatataaacaaatggtacaggcagattaagaacaactccagcattattattattattattattattatttttttttgagacagggtctcactctgttgcccagattggagtgcagtagtgcgatcatggctcactgtagccttagcctccctgggatcaggtgaccctcccactttcaagtagctaggactacaggtgtgagcttttgtttttttttttttttttttttaatagaaacagggtttcaccatattgcccaggctggtcttgaagtcctggcctcaagtgatccacccacctcggcctctcaaagagctgggattacaggctccagcatcaaatgtttacagtagttgtcctcacagaaaatgcatacataactcttatcttcctgactcaatgctcaccttcacctcccaccctgactgcagcctattatccctgcagtcagtggacttttaatccagataccttggctgagcaggctcatagaggaaactggcccacagaaactgtgagaaataaatgtatgttgtttgaagctgctaaatttgtggtaatttgttatacagccataaaaacgaaaagaccaaacagtcatatcctgaatgattaaaaattggttgcataagtaaaagaatgtatttgagttggaagatttggggttttcacatgaaaaaccaagtgtgagtaaaataaccgcagaatagctattttggaattctgatactcaaacacttgctagttgaaggagtgctaagattatggatataacaattgattctagggtttcaaaacttatttcccataacataggaaagctgaaactctggctataaagaaaaggctatttttctttctcttgaaataatttgtactattcattgcactgtcaatagccaagaacatgctagaaattacaacgtgctcgcacatatgggtatttctgctatgatgcaacatatatgtttctaaaattcattttgttttgcaaaatcaaccaatagaaaaacaaaggacttataagaaaaatagggttggggcacaatagtcacaaactgtcagtaacacaaaacaaaaagataaaatctaatcaaattgtggtagcacagtcttacacaagtcaaatgggtaagaaatatgtaaatactacaaaaataagacactttcctttgacaaagactttacatttgcttgtggaagtgggagtcagagcattgcagcttgtgagtttttgtgaaattgtggaaggaaggtgatttgaaatcaagggaaagttgtatcactgatgtggatggatatggcccatgttgagggtggtggactgaggtagctgacatgtttcaggtacgtgcatgtctgttttgtacatcttacctggctgggttcaggtgtgtgcaattttctgtgtttccctagtgtttttcatagactaaacagtgcataagcaaccccaaattcgtgttatgctcaaaatgttctctaataaaatcttgtgtcttgaaaacaagtgttaaaaagtaaaactgaccagatgttatttcatttgaatcttacgataaaagcaataaatagacatgaggaaacagctttagacatagagctagtaaacagtcaaggcagattgaactgaggtcttcctcctctgtgcttttcccattaggccactccaggaatgtctcagtctagcatattttaaatctgtgtgatgctatagtttcactactgcaatttctaagactttatattttcaattagacatttattttactaccaagaagtatcctgatccagaggtactattctcccagccatggagagttcctccaaaagacaaaattctatctttgctaatgaaaatgcaaataaaactgtatcaagagtttcatgattttactaggtatttcccatcatatgtttatcatacagctcaaaattgatgtcaagttttttactctactcttttctcaagttcattcactataaattgaatttcatttttctgcacttgggttgtattttttgaaccactgactttgcttatattagttttactatgatattcatcaatttgtttaaaaaaattcagaagatacctcttgcacaaattcattttataatttaagaactcacttcagaatgttgagactctgttaagtatcaattctaggattatgaagatcctgtctaccacaaagagccccacaaaggtcttttctccctcattcccaagcagtttaacttaatgaattcttctggtagaactttgtttagacggacttaaagcaggtaagagttctttttaaaatacttgtggagtgcatgagtgtgcaaacaaacttaaaagcacatattggctcaggaaagctgaggggaaatgataattttcaacagtccaaaatagccatcctggggcttacagaaagtaaggtagcaattagcctaactctaagcctaacaataacacagtcattaatcctgggtgcccagacacattccattagaggattttggcaacaaaattttgcttttctaattctgagtagatataaacaataatcccttaatttattagtctgtttatcacacttattaagcatttcctatgtcttaagaactgtgccacaagacaaggatgccctctcttaccactcctattcaacataatatgggaagtagacataaacaataattccttaatttattagtctgtttatcacatttattaagcatttcctatgtcctaagaactgtgccacaagacaaggatgccctctcttaccactcctattcaacataatattggaagttctggacagggcaatcaggcaagaggaagaaataaagcgcatccaaacaggaagagaggaagtcaaactacctttgtttgcagatgacatgactgtatatctagaaaacctcataatctcagtccaaaagcttcttaagctgataaacaacttcagcaaagtctcaggatacgaaatcaatgtgcaaaaatcactagcattcctatacaccaacaacagtcaagctgagagccaaatcatgaactctcattcacgactgccacaaaaagaataaaatacctaggaatacagctatgtagggtggtgaaagatgtctataaggagaactacagacttacaaatcactgcccaaagaaatcagagatgatacaaacaaagggaaaaacaatccatgctcatggataggaagaatcaatattgttaaagtggccatactgtccaaagcaatttatagactcaatactattcctatcaaactaccattgacactcacagaactagaaaaaaactattttaaaattcatatggagccaaaaaaagaaaaaaatccagaatagccaacacaatcttaggcaaaaagaacaaagctggaggcaccatgctacccaatttcaaactatactacagggctacagtaaccaaaacagcatggtagtgacacaaaaacagacacagagaccaatggaacagaacagagaatccagaaataagactgcacacctacaactatctgatcttcgacaaacctgacaaaaacaaacaatggggaaaggattccctattcaataaatggtgctgggataactggctagtcatatgtagaatattgaaactggatcccttccttacacgatatacaaaaactaactcaagatgaattaaatacttaaatgtgaaatcaaaaactacaaaaaccctggaagacaacctaggcaataccattcaggacataggcatgggcaaagatttcatgatgaagatgtcaaaagcaattgcaacaaaagcaaaaattgacaaatggggacaatttaagctaaagagcttatgcacagcaaaagaaactatcaacagagtaaacagataatttacataatggtagaaaattgtgcaaagtatgcatctgacaaacgtctaatatccagcatctataaggaacttaaacaaatttacaagaaaaatacaaacaactccataaaaagtgggcaaaggacatgaacagatacttttcaaaagaagacatatatgtggccaacaatcacatgaaaaaagctcaacatcactgatcattaaagaaattcaaatcaaagccacaataagataccatcttacaccagtctgactcttactataaagttaaaaaataacagatgctggtgaggttgtggagaaaaaggaacacttatacaccgttggtgtgagtataaactagttcagccattgtggaagacactgtggccattcctcaaagacctaaagacagaaataccactcaacccagcaatcccactactggttatatacccaaaggaatataaatcattctattataaagacacgtgcacgttgcatgtgtatgttcattgcagcactattcataatagcaaagacatggaatcaacctaaatgcccatgaatgacagactggataaagaaaatgtggtacatatacaccatggaatattatgcagccatataaaagaatgagatcatgtcctttgcagggacatggatggagctggaggccattatcattagaaaactaacacaggaacggaaaagcaaatacctcatgttctcatttataagtgggaactgaacgatgagaacacatggacacaacacacactggggcctttcggagggcagaggatgggaggagggagaagatcatgaaaaataacttaatgggtattaggcttaatacttgggtgatgaaataatctgtatgataacccccatgacagaggtttacctatgtaacaaactcgcacttgtacccctgagtgtaaaataaaataaaataaaaagaactgggtgccagatgttgaaggaaaatagtaagatcttaagaaaatggctttggccgggagcagtggctcatgcctgtaatcccagcactttgagaggccgaggtgggcggatcaggaggtcaggcgatctagaccatcctggctaacacgatgaaacaccgtctctattaaaaatacaaaaaattagcctggcgtggtggcaggcacctgtagttccagctactcgggaggctgaggcaggagaatggtgtgaacctgggaggtagagcttgcagtgagctgagatcacgccactgcactctagcctgggtgacagagcaagactccatctcaaaccaaaaaacaaaaaacaaacaaaaaaacacagcttcaagtttgtagatctatggtcattcagtctatgacactgaacacttcctttagtagctcacttgttgaataacatctagaattaaataggagaaaaaattttcctaatagaactataccaggctttacatgattggtagtcttcgttcttcacaaaccagtttattttaatagatatctcaggtagagttttatgaaggcctcaaagcaattaaaacttcatttgcaggaaggacaatcttatacttaccagaaaactacagctaacatgaatttctttgttagacatttgctatgaaggatctttgagaaaattctgtgttagaacccatgacacccctaacatagctatgccattatttttttcttcttaaatgaacagatgagttttgtaagcaaagtaggataccatgattgatagacctttttgtaaagtatactcagatttgctgaaagagcctacataattcagtctgggtgcagtggctcatgcctgtaatcccagcactttgggagactgaggtgggtggatcacttgagatcagaagttcgagaccagcctagccagcatggcgaaaccctgcctctactaaaaatacaaaaattaaccaggcgtggtggcacatgcctgtaatttcagctacttgggaggctgaggtaggagacttgcttgaagccgggaggtggaggttgcagtgagccgagatcatgccactgcactccagcctgggtgacagagtgaggctttccctctctcaaacaaacaaacaaacaaaaaaaacaaaaaagaaggagattacataactcaagaaaaccatactcgaagcctctctttttaaataatttttatctcaaataagggaaaaatcaaaatggaaagaggttatgatcagtttcaccattggcctacagtattgcttcagagaacaaaataaaagggttcttgcctctccccttgctggaactgggcctgccccagggacttggctgtagggttgcaggtactttccctgtcctttgatcttaatcaccaagggagcaattaaagttccatgtccaggaatcacttagtaaagagtcttgcttttagttagagagttgaaggggttgtgggcaatatctaaatatgctttggacattgtatttgatggggttgagaaataaaaaaaaaattctaggctcctaactaactgaatggattcccctcttggccaagggtgaaactgcctttgcaaaattattacacaaagagaaatctaacatagttgactccatcttgcttctgacttccaagctgtccttggtcattcctgggtgtaggccaagctcactttgggaggaatttagtttatagttttaccttaaaacaaagatgataatagcccttctcaaaactaaatcacctttgtaaaactaatggaaaggcacaaggttaaaattatgagagaggcccgaattctgataggataggcatagtttttatcagcccttacagatcaggaatcatgtgaccagaggtcacaagatttgtgaccttcccatttactcctatagttaacattgctatgttagaacccaagattgtattttgtgggggatgttttccagactgatcctacctgaacttgtgattcatgactcaattgatcctatggcctcacccagaggtagactcagcatacgaagactgttttccataccagtatgattccatccctaaccaatcagtggcacccattccctagccccctgcccaccaaattgtccacaaaaaccctaagctccaagccttcagggagactgatttgaatgataactccagttctcccacgtgagttagctttatatcaaatgaactctttctccactgcaatactgtggtctcagaggattgatctggtctgtgcagtgtacagtgctgggtgattaccagagaaactcgggaagctgagttcatggccttggcgggatgggaggttgaactagtctcactagtatgtaatcacttgtctcactgctgtcccctccccaccttttttaaaggaaaatgtacaaatagtaaacttcctgagaccctctttggaaaaaacagccatagatgcatctgtgacttatgtttttcctggacatgccctcaagctggctcgataaaccttgatgactgagatttatgactcagtcactcattttgattgtcacagtataaagggcctgctatggtctgcatgtttgtgtctctccaaaattcacatgttgaaatctaatctcaaatgtgtgggcattcagaggtggggcatttacaaagtgatgaggtcatgagggtggagcccttgtgaatggaattaatatccttctaaaagaggcccaagggagcttgtttgccccttctgtcatgtggggacacatagtaggcaccatctacaaggaagggtcctcccccagacacggaaactactgttggtgccctgaccttattaattatgattgagacaatcaaatatggtctggctaagagaagaatagtccataacattttgatgctgactccctaaagtctatgttttgaaatattgaatatttaacatgaagagcaaattacaattaggacgtcttaggtccatacaaagtaatattctatggactgcctttggaattactaggtttggtcttgggatcagattgaatgaactcagtatagattctgtgtcacttctactcatgaaacacatttactgatggttaatctaagagtatctttaggctaggtacagtgcctcacacctgtaatcccagcactttgggaggccaagacaggcagagcacctgaggtcaggagttcaaaccagcctggccaacatggtgaaaccccatctctactaaaaatacagaaattagctggatgtagtagagggcacctgtaatcccagctactcaggaggctgaggcaggagaatcatttgaacccgggaggcagaggttgcagtgaactgagattgcgccactgcagtccagcctgggtaacagagtgagactccatctcaaaacaaaaaaagtatttttatatatggcaacatgttgctatatagttatgaaataaagtgttgacaaaacttgactgaatgtaatcatagtgaagccaacgttatgtgtcatatgtcacctgtgcctgttttgtcacaagtgctctttacaaaccacttagcatcttcactttgaggttgtatgctcttatttaatgctccatagagttttgagattgttgtgagttttctattcaacattggcttctccaaagatttgatcattttttaaaacagctgtaaacctattcaaaatttatataacatatatttaaaatataaggacgctttctgatttcaaatgcatctcatgcagttaataaaattggtaattggtaatttagagtcacagataactctaagtaagtcaattaaaactgtgtaagaatttgaaaagaggatacagggcattgaggggattgacatttggtggccaagtcattatagctattgtttggaagaatctgatgatattcaaatgatcaaagcaagtattttgaagaaataaatgatgtgaaataactgataaagagatactttaaactgacattatcctacacttaaatataataaaaatacacagtaataaagcaaaataacagatttgttgtttggctacaacatcaagtcattctcaactacatattttgacaatagtgactctaaatattttctcaaactaagctttcctaaatattttcccaaaccaagctgtttctttacggactttatatgcattaattttatatgaatgactatttttctaacataaaaacaatctttacaaatattttgagaattcaggaataaaactaaagcattcaaatgaccactgctcagttgtacttgagagattttgcccaaaattatttaaaagtgttgaactgtagaaggccttaaaatagaacttgtagaatttcaatattcagaaagtaaagtttgttactatgggtcatactgttgtgaaaaagcagaaaaagaattcagaataatcaaattgaaactattttgctgatataatcaaatatgcctgatgtttgttgtggttttaaagactgtattttctctttggacatttctccatctttctttttttttttggtgtaaaatatacacaacataaactttccctttttaactacttttaagtgcacagttctgtggcattaagtacatctacactgttatgcaaccatcaccatcatccatctctggcactttttcactattcccagttgaaactgtacccattaaacaccaacttcctatttttcccttcctcagcagtcaccattctactttctgtctctgtagattgactactctaggtaccttgtacaaatggaatcatataatatttgtccttttgtgactggcctatttctctattgttttactaacataaaagtattttatctgttattaattttatctagtcagaaactggaaacactgacagaatctttggctgattaattacactacaattgacaaaatactgcccaaacataagtgatttactaaaatatgggacatgatgtttaaaattaaaaacctgatgaaactgtagtgtcagtctcaattgcagttgtaatatttttcctatagccaatgattaaaatgtgcatttgttagtgattttaaattaatttatattaaatttactattttcccatctaaagcagaattaattggtcatttttttggcacatgaattaaaacatatatacactgtctttggtttgctaaaagaatgaatgaatgatataaaggcatctcatgtagaaagatttgttcttgttaattagcaggtttattagaatatggtttctttcatctgaattttggagattggaaaaacaatctccaaaatataaagaatgcagagaagtgcaggagaagagagaatggtaagctaaaaattaccatcaaatgctaagtgtcagacctacacaaacacaaaatttaacatacttaacagtggcatgttcagtgaatatgagcaggagacatgagctcaaatctaatgatatctatgatgccagaaactttgtatatgctgaatttaatccttatgacaactctctgagtcatataatttccccatttttgcagatgtcaaaactgaaggtaagaaacggtaagaaatttgcctagtctcaacactagtcagtgtcagagccagaattccaattcatgtctacatttccaaagcccatgttgttcccatgacacaaaattgtagcatgccttacacttattgacttgggagagttttttttcttaaaaatatagtatcaatataattttagcaaatcttactgccattagaaattggtaacatttatttgaggatagacttcaaaatctttatgagacataagaaaatgaagttccagaataacaggaatttgaatggtagttttcacctttcagaggatggttttttgggggtggtaagaaacatctaagtattggttctcatttgggggcatgcttagaggcatcagtagtttctggtaaagtaagggtctttcaaaagaaagacaaatgaatgatactgtataggtgcagttacatcataggcaccacaataaggtataaaagtaaagcattatgactttcaccttgggaaagaactttgaaatgaggaaaacaaaattgcccaataaaggtgatattttataaccaaccagtgtggactagtggagcataaagtttctttaaagacacaaaatagctgtagcttggattgcacatgtggatacatcaaaataaatatgtgtcaatcaaaagtaatatatgagagtttctgctttggcacattctaacttggtgttatcaaccatttacatttttcataagctaaatagtacgaaataatctcatacagtggttttaatttacagttttctaatgactagtgatgtggagcatctttttatatgtttatttatcatttgagttttctcttctgtgaactgacagtgcatatgttatgcaaatatccaaccttcaatgtccaattttgaagtcttctaatagatgtgaaatttgtgtatagattcttttgaactctacctagacaacatgggagagacggagatgcttaccaaacccattctcttcttcccaggcacacagttacagcgtgtttccccatctctcagttgttttgccatgtgacggactgaattctagaaaatgtaatgtggacagaaatattgctatacctattccataaaacttcccacaactgaaccttcattgtgttttaccatttaccagctggttggagaggatcaggatctaaagggggtcacaggtgagacgagtaatcatgtgaaaggctgcacaacagagaactcccacattggactataatttgaatgggaaattaatctattgggttaagccactgaaaatttgaagtttatctgccatagcagctaatattgtcattaactaatatacactatgtatcgttgtgaataatgactattttgtttcttcctttacaatctctatactgtttatttcccaggagttgacattttattatgttttgtttctttcttttcacttccccgccgtgtcacctaggaactctagttcaatgttgaataaaaaattttgaaagtggccatctgtgttttgttactgaatttcgagggtatgttgaagtttctcttttaagtggggttttcttttcttttttttagagtcaggggtctctctctgttgtccaggctggagtgcagtggtgtagttatagttcattgcagcctcaaactcctgggctcaagggatcttcctgcctcagcctcctgagtcactgggagtacaggcataagccaccattccttaagtaggtttttcatacataaacttaattaggctaagaaattttccttaaattcctagtttactaagaaaattttactgtaaatctgtattgaattttgtcagatgttcataggcttgtattaacatagtaatacatattttttggcctttaatctgttaatgtaatgaattacataacagacttttccaatgttaaactatcgtacattcctgggataaatccccttctgtttttacatattattgttgtctaatattttatataatagttggccaatataccaatgtttgctatactgcttttatatcactgttattggttatttttttcattcttgatttacatggccaatgttcatttggttttacttacatatttaccagtttctttactcactactgtctctttcttctcactttttcctttgagttcagctttcttatttctgaattacagtcttcacagttcttcagctaatagcaaagttttaaagtctttttctgacaatgccctttttcattcttattcttgaattttagatagctgggtataaatcctttgaagacactgaattctattctgaattgtattgttgttattgaaaggttcttcttcttcctcctcctcctgctcttcctcctcctcctgctcttcctccttctcttaggtaatatctttgtctttgtttcttctttagatattctctttgtctttgatgttctgtgtttcaccaaggatgcactgtgtaatggctctagttgtgagtttctttttatttaccctatttaggattcttgactttaatcaaatcaattaaagtgtacttttctcccattcttttaatattctctatgtggaattcttatgagacatagattaaacattacttctatgtctctttttaacatatctatatacctctctgtgaatatgcacacacatacacacatatataatatatatatttgtatatgaatattacatatattttgtgtatatattatagataaaagtatatatacatgtgtatttatatgcatattgcctgtgtatataaaattaatcatatgtaagtttaatttctatataaattatatataactttaatttatagttaatttaattatataaagattacatatatatatttgttgtgttttgtttttacttgcagtgccgagaattgaggtaatcatgttgctcagttcatggcacactattgttatcagtgggtgtactatttctcccttggttgtttgtttaatcattcctctttattctcatttcccacttatattttccttctcccataggaatctaatgtatttgttagaataagcaacagcacagtaccacagttgtataaattaaaatatatacccactaaagaacattatgtatttttaaagtacctatttctcactttctatattcagcattctgttttaaagatctatatatgttgctgtatatttatctagttcactgcttctaactgctgcatcttaatatataatgtgctgtcattgcatttccctgattcactcttcagtgctggaaactcagggaacttccaacttcctgctgtgcaaacaatgatcaaataaacattcttttacatgggttttatagacccttttgagaatttctctgggatgtattcctaggaattagattgattggtcattggatagacatatttgagccttatcctcttatattttgcatcttttgctgaatttgggatagtttcattaaattgatcttccagtttgtattttatatgttttaaattttctgtatattatgatgttttgacatcttaaaaaaccctttcttgctgtaaagagaccgcccttcctggctctagccaattcttagagatagcaaaggactcagttaggagcgtactttagatttgcaaattaaccaagttgtgtatcttctgtgtggcctgtacacccccagggaaaaatatgcttgtgtcttaatcatcccagggccatgtaccaggcaattagggactatctctatagtttagagcctgcagttattattcaaactaaccaattctaagaagtttatcctgccctccctcacgcttcctgtcccacggaagctccaataaaattctagttttggttttcctcttacttctgtcttctgccacctgaccaaaacctggtgattccccggtaactctgtatggcatgtggtacccccctctctagaacctgtgaaagtaataataaactttgttttcttgtggctttcctgtgtcccctgtgctgcacctgattaaccatcacctaaaagaactcagaatacgattcatacattttctcttcatctgcctctaatatgatatttttaaaatgtaaatgattagaagctctatttgaggataatagattgagaaaatgattgagcagaaaaagtaaatcaaatgagaatactaagacccttcaaaaaagatatggcagaaattcttcatgtgttttacaattttagaatgtaaactcataatttgttttgagttcatttgaaagaatcacatttgtaccagtcatgagttgatcagaaaaacggatcgtcatgaatgaaatagaatagtggatttaattagaccttgtacaattggggaactggttaagaagtccatgtcaggctgttgctttttcatgtggtatttactggacctggggtcactgtagataagctggaaggcaatcaggaatgagagttggatttgaaataggaaagggcaaggacaaactggaacccacaaggtcagacgggaaccccagaagacaaaatggagcccaccaggacaaactggaatttgactctgtctctcatgatctctaacttcaataatgttagtgacctgcagagaagtttgaacccttcatcctgaagttgcacatacacttggcccaggactgaaggaagtcaaagaaggaaatccactggaagctggagaactgtgggtctaggtgcttctcagtgtcaataaggtgggttaatagattagtgacaacatgtgcaaattgccaatgcctggtgtcatatattgagtttcagagtataaaatggtggcttcttcatttgtgcccttcagttcccagaccaatgtgctttatggcctactccaaattgagaaacacacaaagaaataaattctgagaatgtaattccagtttagctaggttgacatagtataaaaccatattacactagtttagttgaaggtatgtatctacggatatattttgtgtttatttcttttaccacccttgaagtatctccagctttggattaattttaatgtaaatttttcattttggagctttctagaccaatagccaaacttaaaatgagttacttgacagtggttctgggttctcaaggaagagtctctatttcgccattctgaacagaggctgagaagacaacttacccagttatttccctatacctatgggcatattagttcacacttacgctgttatttagagtggagtttctctaggttctagactctggtggtctctgttccaactccctataggagtagggacagacgaccttatctcctgcctcacagtggatattaagacatcagcctctagattacctaagacagcccttccccagagtagacaaagagtcagatctgggctttactgctgtgagtttcagttctctattattctctgtcccctgaagagctatttattttccttctagttcagaaatgcattaaaaattaaaaaaaaaaaatctagatttttcagatgtttttagttgacattttcaggctaactactctgccatgttacctgaacagggagtccattgcatttgcaaccaagaacttaaatgcagagacctcttttacaaggatagggtgctttagcaaattcagatttacaggaaagaaaattacaaatatacaaaacagatcaattagagggatgaatttgcataacaaaaggactcgccataggactagttaaaatagctaggatctaacagtgaatttagagcatctaggaaaatgtgcattgtataaatctatcaggcctgtagttaaagaaatgcggggatgaatccttttgtaaagcagaaagtcctttttgtaatgtgaatgagtactctctaatttacaagtctgtaagtttgagaagtttgagtctttgtgtatctggcttctcaaataatagagatccagaataagttatttatacagagagttcaggtttaactctcctgagtatgatttttctatgttaatataaaataatcaaaacaatctgcatatttaaagaatggaatcatgaggtccttcagacgtttaatatgtgcatttctacataatttcccatgggtcttgttactggaaatatgttgaagacaaatgtttccacaaaatgaccgatttcttttgatagatctatttaagcacacagtaaaaaacatcttgaccagaaacataattgctaattcactgtgttggacattagctattgagttattaaccagttatctgagggcctaccatgtgctgatcagagagtcagagttccttagatatcaggtacccaaactcttcattttccagatgaagaaactagtgatgtcaaatgacttgataaacagtttcatggctactcagaggactgcatgaaacttccagcatattatactgctttctttaatagagtgaaagagtccactaaattaaagaggttgtcaactccatggatgagaaatttatgttaaggaaccatgactcaccccgaagggtgccagactgagtctgtggcccagtgcaaagggcacagagacatgccatcagacaggcttgtgcctgcatgtcttgcattgacgttgggcaatttattaacttctctgaactgcagtttccccatatgcaaagcagaaaattaatactcatcctgccatcctgaaaatgtattgttagaaaagaacattattatatgggagatatactttactgtataaactccaaggtactttaaaaatgtcatttgttatgattattgccatagctactctagagaatgcatatatcaaaagatctatgaactttcacaaatatttttgcagaataatcaaggaacaagttgttaacctttttctcagaagcaataaacaagaaaaatctagactagatgtttatacaaaaagttatttacaattcagagctgtgtccaatgtcatttgttatcattattcttatatgagtgaattaaatattttttaaaaaattaatacatggaaagcaatcagaagaatgatttgcacacaacaaaatgtatatgaacattggttattgttaattatatcctcatacttttctattcctcctgcaattgtgcaagccaaactctctcaactctgaattttattttctattgtttgaaatgacaaagatcatgggtagctgataattcaagcattgtttttgctcaatgggaagactaagatgttgctttagggagtaaaagtatggggagacattgtaacaacagctatagtgtcaaaggacagtgtgtttttaaatgtatgtatacattatacatttattcccacttagcttctgttataaaagtcctgagacatcttctgggctttgatctgtttatggatccagatggcagagaggtgatgagaccacaggttagagagaaaatttagtcacaagattggaaattataagccttttactgcttaattattcccttcctgaatttcaggatatggtcacctatgaaggttattttacttcaatcaatccttggatgaagaagacaataaccatagctgtacaaaagaataatgagatttaagtattgcaccgatttttacctacattctctaattgctcattacctaaggcagctcagaaatgacgaactggctcctttttcatggtcaggacagctgcttttatatgttacatacttgtttaatatgaacttcaatggtttttagaagaaggaataattagaacaggtacagccaggggatttttataactcctttaatgaatactaaatagtattttatctttaaaagggaccatggctgcccttaactgcaaccaagttcattaataaaaagttttcatgcagcagacacaaaacaatataaagaaaccagagaaaaatctaaactgagagctgtagttactatctgtgctaagtgaatcaagcctacttgcaaagatgcataattattttttaataaaaaagaaataaaagattttgctggcttaaccaacgataggtaatgatactaaaaatgacatgagagtaggatgctgtatactgattccagctgcttctctttcgagttgggattatctgaattggaaaagaaaatccccatttccccagcaaggtacagattttacaaaacagagatccatccttgacatggtaaatatctaatgaaaccacctcttctttccatttttttcccaccctgagccacatgctgtatattaaataaaggactcaactttgttcgtactggagaagttgtctgggctgctgcaggatggaggtttacctgaggttacctgtatgaagggtgaattgctcacgctttagagcactgttatctttctccccatgtactccttcaacagcacaatctacagtgaagtacttgtcagggtaagcggtgaggaaagtgagagcaggttgatcaataaaacatagactggaggaagcctcttccacaggaaactaacaatgcataagaagcatattcttaacaatgtttggcaggaaactcagcagcatgaaatgtacttaatgtttaacagaagttctggaagaaggcagctttacacgtgacgtaaagaagattgactgaaggcatgctggggtctctatggaaagagatttggatgtgaatagacctgggcttgagccctggctccaccatgttctcaatgtgggaatgtgtgtgagttcctgctcctccccttcctctgctgtaaaatgggaatggtaacacctgccttaccagactataagcaaacagtgatctgagatgtgtgaaagctttgtcaactctaaagcactattaaaatgcttcaggaaagtagagggaatttatcctggtcacctgccttgggaacagtcacgaaaccataatgtgttcccagtcctgacactggcttccctctggctcaaaaactgggtcttgcaatgactggctttcttctgattttcaaggttgagtgactggcagtctgcctgggcacacgtcaaagagcaccaccacatcaactgcatggctgcagtccctgtgcaggcagcttcctttgctccccagcaagtgcaggggctggcagaggctgcttcagccttgtattgtagggggaaataggtgccacatgctgttatgaccatggtgatggtgggggcgactggtgcttctacataccctggttctaagctccttttctggatctttgtagttacacatgggagtcaacagcccactgccttccctttatcctctatctaccccattgccttcttccagcttccccccaacccccacccccgtctaatgaaaaagaagttaaattcctatcttagcatcaaatccagctgtagttttttctcccaactaagcacatgcagtacggtacctcctcctgtaccatatacctcctccagtaagatactcctgatctctttctcctcctctaggctcactttaaggtccttgttgtatgtgaccctatgtataccctgaatgtggttcttattgaactgtactataactgttaacttgctttcaattagaatgcgaactcttcaaaggaaattcttactcaccagttgtctctccatcatctagcatagtgcttggcatacagtaagtagatgtaaatgattatcgaactgaattgatcagaccctaccactcccattgatttaaaattatacatatgcaaagaagggtcattttgagaccacagtgcaatcaagatgaacatgtctctaacttctgacttctctctttctgaatccgtctaccctagctcacccatctgtctctgcaagaagggccaagaagagcacagactcagtcaaacaaagatggaacaaaattggtcacaacttgaactattccttctttattttccatttctgttttgaccctttaaaaggaatttcaaaattttactttcttctggtgctactaacgtaaaatgcctaataatctctacatggatacacgatttgaataattatacacttgatggggttataaggaaagtttggaaatcatcttacaccttctagacatattccaagtcaaattgattaaagaaattagttctttctccttagttctaaatcatatgccaggaattccaggtttgtggatttgtcatttaattgcatattattgataaatagtattaaagacctttcctgaggactcactgttctgagtggtttctatagctctgtgacagatgttaccagttggccagtaaaatccattccaatttcctctctcttgcttgttttctcctgcagagcctggaaaaagctaagacacactttcccagtctcctgcaagttggacggtggctgtgtgacatggtctggccaatgaggtgtaaacctgagtctgctggaaagatactggaagaacttttgatatcctgataaaaggaacacacatctctatcattgctccctttccccttcctccatctgggaatgcagatgtgatgacagaagctgccatagccactctgcagtcatgaggcaaaaaacacaaaagcatgaggacaaagtgccatcatgctaaggagagcacagcaaaaagacagaaaggctctggtcctaaatggcacagctaacaagtgcccatttccatgcctcttgccaaccaacacaattcatgtccttatgatttcaatccctggtggtcaggttttggtcacttgaagctaaaagcattcctaactgattcaaaccccaaataaaaacattgccctaatgatgaaacagaaattggttactttggcctcaattaaaaaatgaaatgtagctaatctttaacaaattcaatcctaaatagttctctttatgcctactgtcaggcaggcccttcttctgtggctggatctgatttcctaaagccttaatttctaactcaacatagcaaagaggtggagggaagccatcgtgcccaaaccctcatgggggtcatgacttacagttgactgaggatggcctccatttatcacatagtctattgcaacttgaggttcctttaacaaatactaggttataacatttaaagctgatatcacagcttctgttacaagaatattattgtactagtttcctaaggttgttgtataaattaccataaactgggtggcttgaaacagaaatttattctcttatagttctgggggccagaattctgaaatcagtgtgtcagcagggcattctccctctgaaggctcaaggggagaatccttccttgcttctttgagcttctggtggctccaggtgttccttggcttgtggcagcatcacgccaatcttcgtcttgtctttacatggccttctctgcttcctcttctcttttgtctgtcttcttttcttataaaaacacttgtttgacttagggcctatcctgttaatccaagatgatctgatcttggatcctaaatgaattagatttataaacactccttttccaaataaggtcacattcacaggttctacgtggacatatcttttggaatgccaccattcaatctactacaactctagaaaatttattccactttccttatttatttttgttgggtctcatgaactttgatttttttaagctgtgtgaggaaacatttatggcaatttaagttttgtgttgcatcagaatttaaggttgtttcaggaaacacgtgttttatttcacattttaaagtaaagaattatttctctgattacattttagtctttatttctcatgttaaagtaaaaaataggtgacttcagatcagtaagtatatcatggtagtgatattaaagagtatttactaggcttagtataactcaggcaaaacatttcttgcaaattattcaccataatctttgacataggctggattattagttttaaggcatgaattactttctacccaggtcaatggtttttaaccctgttacacattatagtcacctggtgaacctttaaaaatgcatgcccaggacccatttcaaccaatgaatgcaaatatgtggggatgagcttgtgcataaaagtctcctaagttattcttatgtatagtgaggattaaaaactgaccttgactcttattagcagttgccttattcaacaccatttatttattcaatcaagtaatcattatgcacttttaagtgtgtaagtagttgcagtacatataaggacatataagaaatgcaggtttataatttagtagtcatggtgtataatattttgtgtaatgtgccatttatactccagggtggtagagccaaatgcttatagagaccttctctgctggtcactcttaaaaattcaaatcaatttatagaagtaacttgtatcacaaaaaattagccaggcatggtgaagcatgcctgtaatcccagctactcaggaggctgaggcaggagaatcacttgaacccaggaggcagaggttgcagtgagccaagatcgcaccactgcactccagcctgggtgacagagtgagactccatctcaaaaaaaaaaaaagtaacttgtatcattattgctttaactcctctgcactcaggtgcgtgtgtgaacacacacacacattgctggtaataatcagagcaaaataagactcctatggttgactatcttcagattacaccctttacaaggtcaggagccttttaattattttagatcccccttccgcagagtagaaaccaatatatgcttgtaaaaactcacgactggtagtgatccctattagtagaaaaagcttgagcagtaaagttgcctgtgccctggagaagtgctgaggactagaaattcctctagcttccagctatttgggaagacccttgggtgttgagccaacattggcaggtgcgaaagggaatgacactggggctgaggagaggatctggcagccaattagcagcgcttgttagagctcaccccagactgctgtgtgactgctcattcagacattcatagacacccctgtcacaaataagccacccagagctctgtagtcgtacaaagcagcaataggagtggagaagaaccatgtttgtcaggaaggccctgcatgcaagagagcggcagggcagagagcagagtagagcttggaggctatagttgtaataagctttcaggaaaagagaactgagcaccttaattattttatttttttttttgacatggtcttggtctgtcacccaggctggagtgcaatggcacaatcactgctcatttgcagcctgatctcctgggcttaagcaatccttccacctcagcctcctgagtagctgggaccataggcgtgtgcaaccatgctcagctagtttttgcattttttgtagagacggggtttcgccatgttgcccaggctggtctcaaactcatggactcaagcaatccacctgccttggcctcccaaagtgctgggattacaggcatgagccactgcacctgacaagcaatttaatccgaggagtcatggagtcttatacatgtgaagtcttgttgatgaaagataggaagatggagaggagctggaggagaacatgatattaagccaagtatttaaaaactactgatgagctaggaatcaagctgagtgcattcattcatatgttaatcaaatactttttgaacatcttctatgtgtttcaggtgttgacagtgcagaggtgagcacgtgttctccagggtgaaggacactggaggagatttagggttataaaaacaaacagataacaaatgcacatatattcagagtaacatgatagaaatagatggtcaggagataccacctcagtttgggcgatgaggaaggccttgacccaaggaggtgacatgatgtgagctgagatgatgtggaaggtgttggggcttagaaaacaacaccccaaaatgaaggcctcagaagcagcctcagaagcaaaagtttttctctgaccttctcctgccctcctgtttctcagtcccattctctcctgaggctagctatagaaactaggatccctcttccccagggtgggtcatagaaaccagaccccttcttccccaaagccagccataaaatctaaaaatattactctaactttccctccacctttctatgtgaaaactggccacagagaaattatctgacttaccttgtttgactgtaggtcgtaatacccccattccagagagggtcttgcccaacacagagaaggaaggaatgcatgctcaggggggccaagaagaatctagacagacaggccttcctggctttcttcactcagtctattagcattagatcagaccctttttttggtccaataatatttcggcacagctgtccatactttgttgaaacgaagtgtaaaaatggacaatctccccagtatttttgggtcttcatcctgaaggctcccatgtttacatgctaaataaatttgtatgccttttctcttagtaatctgcttgaatgtgaattgatttttcagcaaacctttagagggccaagggcaactttcttcttggccccaacaaaggagaaggacggagatgcatgtaaagcggtccaggcagagggaagagcaactgtaatggccctgaggcaggaatatacttggagtttgcaaagaatcagatgatatccaggctagaatcagagtaagggcatgtctggaaaaagtggaaaaggcagcaggggttaatgataagcacgtggccatggctgggcttcgggaagggtgaggcttcaggtctttgtggtttggtctgaaagcgactgaggttccactgggtgagctgctcagggcacatcctgatgcagacagcctgttggctctgacagcagctctcccatcctcccagctgcaatgactgccgagttggctttgctttgagtattccaatcacacagggcctgcacctctctgcattccctgggggtgattttgatagtttctctgtgtgcacagtgattttgaggcaggagatacatgagcgactgcagcagcataagaagtcagtggtgtcaatgcctgacaactaccatgactgaaaaagttagattcctgaagtgacttcatttatattgccatatcctgacagaatctgaggccactcttggtatatgaacacagtatcatcttatatatatggaaataaaaaagaatgggaggtttttttttttcttaagcaaaaggaaaatattaactcaagacccaaactgttttattcatttgtggactcccacaataccttccttacacagttatttcactgattctagaacacacacttttcctcatttaccatctgtgaaatgataatgcatcttacaatccacagtgcctcacaattgccatcacatggttgtcatagcccatacccacatgcttggtcatagctgttcatgtgttgagtataattggcatttaaactgtgttcaaaatgattacattataatttggcatcagtacttggaaagatacaaatacagtagggagaggataatttgatatttgtgaagcaaataacttcactggagaagagactgcaatgacatatttcctttaaaagcagtaaccatgtgcattgtgggtctgaaggaaggaagatatccacaaatgcatgaggccttattatgctttgttactgcaatatatgaaaaagattacatgttacatgccaaggaactcaacaaaggcaggagtaattgacaaagccctctatatgaaggaaatgttcaatctgtgtgaggctgtgatgggtttatgtgttggacagaatcaccataaggctctgtgtcacagattaattggcagcacttgtttttcttttgtaggaatgcataacataatgatgcatcttataatagatggtatttctaggttccatgaaatagagtggaacaaagtagatgtttttgtcgttagactagggctatgcaaatactagacctcacttatcccatcacgttcaaaatgtctctgcagtttatttacatattaccaaagagctgtccacttgaaaacttatagtcagcattgtgtctcaagccaaggtaaaccaaactaaacattcttatggcaacatggccaggcgctgtggctcacgtctgtaatcccagcactttgggaggccgtggtgggcagatcacgaggtcaggagttcgagaccagcctggccaaaatagtgaaaccccatcttgactaaaaatacagaaaactagctgggtgtggtggcgggtccctgtaatcctagctactcgggaggctgaggcttgaacctgggaggcagaggttgcagtgagccgagatagcgctgctgcacaccagctggggcgacagagctctgtctcaaaaaaaaaaaaaattcttacagaaacttgatactcttggttggtgaactgaattttatcaaaagcatctatggcacacaggcagatgattgtagaatacatggccttaatgaaaaataagctaactgcttaggcgattatttcaaattcagtttaaggaagtcactgtgttttagcgtctgattttgaacatcaggactaaagaccctgaggcttttttcctttaaggtactatcaggtcagtgtgaaaaagctgtttgccaggggagccagttggaaatgaatgaaataatttacattcctgctgtgggcaagttgtcaatcattatgtgtgaagcctgtaccatcatttttctcctatatctacacaaggatgctgtcttaaggatgtagtcaagtgccgtgacaaatagcaggtcaatagctgaggacacgttgcctggtgtgtggtggtagagaaagggcacacctctattccccaaactccaggccggctgcttgatgtaatagcaggttgtaaagtgaaaaagcttctgcatgaaaggatagcctttacatggggtacagagcgcagaaacgttttttggccacacattggtttttctcagccatggatcataatgattatcagtagaatcatttgttttaaatgcagagaagagctgaaatgcttctatgtatcattgcttctggagatttctagaaatgtgtgctaggtagttcaatttaccatgtccaaatggaactcttgatttctccctccaaattttccctaacaaatattcccaatctcaagaaacctcaggccaaaaacatttccaccgatccttaattcctttgatttatctacaatcaatatcacattcatcatctctattttccttgtaaatcctgactcagatattctcaccttcttcaccacaccactttagtacaaggcaccaccatctcttgccccgactactaggtgaatgcctcagtaggttttcaatgacctccatccccattcccacagcagccaaagtgagcctttcaagcataaaccaaaccatatctctctcctgtttaacacccctctgatgctcatgctcacatttagattactatgcaacccctctccacagctcacaatacctgatcctgggccaccactgtgacatcttttctatcagccttttccctggctcatgctactacagccacactggcttccttgctggtcctcaaacaggcacggtcctgccgcaggggatctgcacttgccgctccctcagcctggagtgctgatctctgcatggcttcttcccacacttggttcagatctctgcctaaatgaaacctccttaaagaagtctttcctgatcaccctcctgaagatctggtcactgtctatcctcttaccctgctctatgtttccttatagtatgtgccactagctgatatcatattacagacttatctgttacctgcttattgtctttgtccagctctagaatgtaagttccataagagcaggagctctgttggttttgtttccaatgcatttctagagactagaacagtgcttggcatatagtaggtgttcagtaaatattttcattcaatataaatactacatatacttcttcatatgtcgtcttcccagttggacactttctaggcatactgggccctcacaaagatatatagagtgtggactacctttcaactgaagcattttaccggacatgccaactgatggcagcacccagggatggcaatgagatggtgtgtgcatcacccaagtggccctccacagtcaagtaggtcgctgaagtctgtctctgatgactttgcctcccacgtcttcctctgtgtctttctttcccattcctcccctggcagcaattcattcagtgggtatttttaagcacctgctttgtaaagggcattgtgtgaacatacagctgagccctccgaagtcaggtcttcaaggagtttggtgtctggtggagaggcgcgatgaacccacacaaatacaagggctggtaaaaggtgaagtgtcttgccccagtggaataaggaactagaaactgaaattggctcatctgactctgagtccagcctctcatccactctgctgccttgcagcccacccaagcctgccttccctctggcgctcctctgcagtttgtttgtttgtttgtttgtttatttatttattattatactttaagttttagggtatatgtgcacaatgcgcaggttagttacatatgtatacatgtgccatgctggtgcgctgcacccactaactcgtcctctgcagttttaatctttgttctaaatcctccttttccccttctctatattcaaagcaccaaatcctgcccttctaggtgaagttatacatcagctgatgatcagatcagactagttcacagtaagtgagaatgactcatagatttagttctctcaggtggcgtttgtattgtagtttgtctctgctgcagccagtcacaaggagatacatgtgtgggagtatctgtttctctatttttggggggactgcgggaaaaaggatgccacctggggtctgcttatttactgtaagtctttctaccttaccctgcctcttgggcttccataatgaagtaggtctggccatgggtctttctccttccttagtacaatttctaaagggaaggcaatattccatttttggcatttgggaggtggtgaaacaggcaccctctctgttctctctcactctttctctctctctatgtgcgtgtgcgtgtgtgtgtgtgtgtgtgtgtatagtggtactacagggtcatttataccagcacgcctcataagttgcacccctgttcgtcttgtgcaccatgtgccctccagtggctgccacgaagaagaaatggaacttcctaagtcagccatcctgacagacactgttggaaactttctctgcaaggctgagaacatgagggaaagactgcggatgttcattctgttgttaaacgtatctctgttgcaagaccagcctagtgtaccgcctttcatgacacaatacatctgtgaatataaaataacaggaactggtggcttttctcatcaaaatccaaccagttctcttcagacacttcttaacctgtaaaatgggaatggcaacagtgtgcatctcatagggttcaggtgaggggaaatatatcaggatatatgatgtatatatgacatatatgtcagacttagaacactctcacacaaaagtgtctttaggtcaatcaacaggtatttatttgccacctccggtgtgctagaaactgttctaggagctggggatacaggagtcaacaaaataatctatgccctgatggggctgattgtggttaataatcatgatagcaaaggcatagccaggatccaaatccccgcagtctagctccgagtccccagtctcctccatgactccatagcacctcttgttcactgagcaagagaatgcgaataatacacttgagatgacgttgtgagttgagagcctggacctcagggataaagacctgtacttggcagccatctactttgagtctgctagctgaaacctgtccaagaacataacactggggaaaggaggtttgagaaaaaattcttgagcaagattgacaattaacgaaggggaagataaaggaagagttactaaaacaaattcccattattgttactactattattccctgtgctcatctagaggagtcaagtaacctaaggaatcaaattcaatgaaaaaatattggttgcacacccactctgagcgaagagtggatgtgcaacaaatatttgagcaaggcacgaaaatgatttttcattagacagatactttgcaatttaattttctaaaatagctgagtttgatggtcaatgagttcaataaacaattttccagctttttatatatctagcaattccatgatcacacagtgtgtttatcatctatcattctccaattactgaatattggttggggttcctgtcccccagttttccatacatttaggcctccttgcatggtaccctatccaggtcatttttttccccccggtgagcccccattgatcatcttagattttctgagatggttttgatttcacatattttgagtgggggcttacaaacaataataagatcatccataattctaaaatctctcttcttttctctaattaaaacctttgtgggccaggcacattgactcatgcctgtaatcccagcactttgggatgcctacataggaggatcacttgagcccaggagttcacaacaagcctaggtaacataaggaaacaccgtctctacaaataataaaaataaattagtcaggtgtggtggtgtgcgcctagtcccagctacttgggaggctgagaagggagcactgcctgagcctggaaggttgaggatgcagtgaaacttgattgcaccactgcactctagcctgggtgacaagtgagaccctgtctcgaaacaacaacaacaaaacaaaacaaaacaaaataaaacaaaaaaacccataaaacaccaaaataaaacaacccccccaaaatctctggggtgcactgattgcagtaatggtcccatttcttcacccttccctactctcaagctatttaccgtgtgattttgcagttgctcctattgagaggtgaactatatcctcccctcccaagctgattttgagttttccatatagcttcctttggccaagtgttggcagatgtgatgtaagtagaggtgtaaaaaagcgcttgctcatttttgtttgtttgtttctttctttgttatgaagacatgtctgcgatagcatactagagagtggggcacagggagtcccagctgtttcagctgagaccaccccaggtcagtcaactctcatatgccagaagactagagccaactgccagatgtgagggagccagatgagatcagaagaaatttgcagccaagcccagcctaaatcgctgacccacaaactgtaagctcagctaaacaaatgtctatcgctttaagccacttcattttcagacagcttgttccatagcattgttgaggcaatggataactgataatgcttcccataaatcttaggaacttggaagctgcccctccatttgccctcctttaagcaaaaaattgaatgctatttgcaaagcattgtataaaatgctttattagattatcttattgaatcctgacaacaatatctagcagacagatataatgctattatccaaatttcagaggcaaggaaattgaagcttagagaagtttaagtgacttgaccaaagtgcttttagaaaagcagagattctacaaccagtcttctaaatcttggaagactgcttttagccacggctgcctgccatttactctttggattctccattctacctgttctgctgcctacttctaccacctaattaggagaagaccttgtgttcccatttgggatatagatacccactttcatactgggtttacccctaatatttctctccataccactcatgtagatggttgtcttccgcattaatctggaaattttttgagggtaaagactaaaatacttatatttttatccccacaactctatgcagtatttttttaaaaaagatcatagtcatgttttaaggtagctattccataaaacatataaaaaggtaaaaaatactctcctagagaatatatgcatatttaaaaggacactgttattcaaattaatctaatttgtggaatacacagtagagggttttccccattttgttaaatagttttagttatatgttatttgaatgtagtgtttgcctgaatatctacaaaaataaaactctcttgactcatttatagattaattccagaagcagggattaatacaaaactggcagtgaataatttctgttttgcagttagtttctgcatttaagaaattgctttagggttcagtaacttgccctggacttcaggtatgctgccaccagatggcagcagggtgccaggcataaggcttgtaagcaaagaatttgtgtgctttctgaggctcaaggtaatagctctttccttaagttcaaaaagattttcagaccactgatttccaatttagcataatacatttctttacaaaaataggtaaactaaaactctaagccaccctaagacatctttagaacagatataaatcccaagctataaaatcacctaactcattattacttctcttctctagcatctaattatttctgtaatggcttatacaccatgatggcttatacgaatcttatacacctacctcagtgatagtgttaaccattataatttactttgaatctttatgatcaatctctgccatggcaccgtgtatgttagttttcaaaattctcaatagtttttctccaggtaaaaaaaatctatctggctttcctttcatctgtcttaagagagcagaggtttatcttttcagtattatctgagatcttctcttaagaccaaaagtatttctccactacagtggcatgaacagtgtttatttgcatttcgtgtatgtatttgtgaatatggagtacttttgcttttgtattttctatactatataataatctactagaatatttcccctctcaaagctcttggaagcacagaggcagtttaccatactttaacagaaatatagctggattaaaattttttttttttagcaacaggctctgccctaaatatctcaagaaaatactttaaagaacaaaaatcttcatgccaaattagcaagatacaggaaaaaaggtaagtgggcaaaatacagggaaaaaaagctaattcaccctgacagttgttacacaaagctgagagagtctttccctctcacatttacaaagtccaggagcggaaagactttcagcaggagtaagccatgagggtttggacaaggctggtaggggaaaatgttatctcctgggcatactgggaagctgagagtccagggcaggtgaatggggttggagatgggaatgagggaggacagcatctgagcagtaaatcctggaactagagttagcatatcaagcagggctatctatgcacccaaggtaagttctggctgggagaagcagatggcaactaagctgtgaaaataggctccaagggaccagctcccagcgtaactctgggggagggatctggggaagtacaaaaaacatagagaggcaaaagacaaataaaataggaggagaagagaaagggatggatcatagaaagctcttatttgattttgagtctcacaggaaacccatgaagccagcagggcaggtattttttatcctctatttacaaatgagaaactgagtcccagagggggtaagtgactttttttaaggtcaacataccgaggggcggatataagattcaaagtcaagtgacctgattccaagctaaagatgaaagaagagagggcacatttgaaaccctgacacacacactgtatgtcctactctttgctttataaacagtaagtaaaattttcaaataatggaagcttagtcttttaagggtcaaacggaagcagctttagccactgttgaaaagcatttctgaaatgtattatatttgcccttgcctcctttgaaaactgactgtaatctactctcttcttgatacatgggttataattacaaaaatttactatatttatgaacttctaattcagtagataccctcaggttctatggaggcacatgtgttttttaaaaaattaattttttttgctgccccacctaatacattcatggctagaaatagctgtgtagcagaactggctgagtcagctccttcttccctcacagccagctcttccttcttaagtgtgtctgctgctggtccctatctactgcttctgatcaggtcattccgcttattaaaatcctttagtgactccctctaaccactggttgcagtagtttgcaaaacaggctgcacatgaaaatcacttgaggagcttttaagacctcctgatacccaggtgccaacacgaaagatttcaattcaattgttttagatatggggccctcacctacagggattaacataagtagcatgaactcttgcttctggccaagatggaataacgggggctagatttatctttccaatggacacaactaaaagtccagatgaatatattaaacaatggttttcaaggcaacgggcatgaggcattgaaggacagtgatccctgagagatggaaaacaaacaaaatgagttgcatttgcctgcaattgcccctgagagaatttctaggccatgcagcagaaaggaagaattcagaaggagtctgcaagactccttaaatagaaaagatgaagcagagaatccaggtagactagcgtggctagagtttgccaggcagagtattagagagcagggagttctgatcagtacatgcatgtgaggaaatggtataaaatcaaatgaaaaaccagctgaaaagatgagtaggaatagtctttaaagttcaaactggactggtaaaactgagatttgaaaactattcaaattgggaagccctgaaattcaaagagcattggtcaagtactcagaagggtattgccctcgtggtggggaagtattgtcaatagactaaacaatactctgccttgcctaaccttaaaagcaagacctgaaagatcaaagactattcaaagaattttcctgtatcccagagcaatacccaaaaatatctgtaggaataaaaaaaaaatccagcatccaacaaggtaaaattcataatgtctggcgtgtaataaaaattaccagacatgcaaaaaaacagcaaggagaaaaatcaataaaacccaaacctaaactgacacaggtgttacaattagaagacaaagatattaaaccagtaactgtaactgtattccatatgttccacaagttggaggaaacagcatgtttaatagagacagaaaatataagaaagacccaagtctggccgggtgcggtggctcatgcctgtaatcccagcactttgggaggccgaggcaggcggatcacaaggtcaggagatggagaccatcctggctaacacgctgaaaccccgtctctactaaaaatacaaaaaattagctgagtaaggtggtgggcacctgtagtcccagctacttggaaggctgaggcagaagaatggtgtgaacccaggaggtggagcttgcagtgagcagagattgcagagattgtgccactgcactccagcctgggcaacagagcgagactctgtcttaaaaaaaaagaaaaaaaaaagaaaaagaaagacccaagtctaacttgtgaagatgaaaactataatgtccgagataaaaaatacactgcatagtaacagtgacagattagctattctaagaagaaaagatgagtgaacttaaagacatagcaatagaaacaatccaaatgtgtcacagagagaaaaaagactgaaaaaaaatgaataggacattggtgaactgtagtacaactttaaatgacctaatactgatgtatttggggtttccaaatgagaggagaaataaggtgagtaatagaaaatattctgaggccagatatggtggcttacaactgtaatcccagcactttgggaggccaaggcaggtggatcacttgaggtcaggagttcaagaccagcctggccaacatggtgaaaccctatctccactaaaaatacaaaaattagccagatgtggtgtcgcatgcctgcagtcccagctacttgagaggctgaggcaggagaatcgcttgaacctgggaggcggaggttgcagtgagctgagattgtgccactgcactccagcctggatgagagaataagactctgtctcagaaaaacaaaaaaatttaagagataatgactaaaaaatttccaaagttgatgacaatgataagtctcatatttaagaagctcaaaaaacttcgcacatagaaaacatgcaaaaaatgataccaatgtgtgtaataatcaaattgctgtaaaccagtgaaaaagacaacaccttcagtgcagccagggggaaaaaaactgacccattatgtatagaggaacaacaaaatggcggcaggtttcttgttagaaataaagcagaagagaggctggtggagcaatatctttaaagtactgttcgttagaattctatacccagcaaaactatgtttcatgaatgaaggcaaaatgaagtatttttcagacatacaaaagctgtgaaaatttatcactagcagcctcacactatagaataatgtcaaagacagtccttcaggtagaaggaaaatgacaccagatggaactaagggtctacataaaggaatgaagagcttggttggcttcaagggtgtgtgacctgtatggttacacaaggtcctgcagatagaagggccttgtgctagctttaatgttttgatgttactggctaaaaatttttaataatttttgaacaaggggccctatattttcattttgcactggtagctggtcctgatgaagaatacttagtagtccatagaggtggaggcagaggctggaatgccgagcttggctctgaagatccaggccatatgttcaggcatggaatagggaagagatggaggtggcttcttcagaggaaatttggaatgttttaattttaatcacgagaagggtgaatgaacagatgtccactaaaataaaaattttaaggtagcaatttctgggtaattagaacacaattttcctttctgcacagagatagatcataaatggctataattagagagtttcagttttttctgaagttcatttgttgcggagtgttcaaaactgtctcttcaggccaaaatgccttgtttattgtgtgtgtgttttactatttctgatatcaatgctttaataatgcctgttctgtaatattggcccagaggtactgcaagagtgtaaattcactttacatgaaaaagaaaagctatattacttccaatgacattttagtgattaaatgcattttatttgtagtataattctatcccagtttaggtcaaagctccgaagttgagagtagtataataagtgtggacatgcaaaagatgctgaaaggtagtagaaataataatgtcagatctagcccatcaccaccctccagaacatatatgaaaggattagaaatcaatgttaagtgtgtatttatttgggagactgtccatcctaaatgaggacaaatgtcagggtgcttttcccaaaacttgggctggctgagggaagcttcaagagaatccctggaacagcttgaaatctggatgcagggggtggagttggtagagtccagaagctttacctgatatatgcctggaaaagtctaaagctcagaggtggtatctagctgtcctgaaggcttgtggggagccagctgtactgtatataggtataaatgcaatgcttaaatccacagataatttataaagttcactctacacttgaatactcacatccagtcatttagttgaagccttcggctttgattaaagttgttaatatttgaagtgctgactgatgtaacctccctggtatggaaatatgaatatttctcatttattatgtcccgtggtgaaagcataaccttttacttaaaataattggtttgaaaatggaattagaatattcatcctccccattcctcccctgcaatttgtgaatttagtaattattcttcttggttatgagcataagttaccatttacctttattcaatatgtacacacgcacacacacacacacacccacacactctcacagaatgcaaaaaaaaaattaggaaataaagttatcgcaactttagcaatgagagcggggtagacagaagtgtgagtttataatgctgatcatgaaataaaaacttcaaagcaagcctaaatctgatactcataggatgatagctctactgcatttaaagcaaataaagttacatttctcaagaattaatgcaaaattagaaagtttcctttgaaaatctcttagcacatctccaagtggttagctttcctgggaaagctggaaattaaatcaacaacattgaaagaaaaaaaacctcacagtcctaaattaaacagtcatgtaaatatagtttccaaagctattaggcaagaagcaaatgattttctaatcaatttactgttgcaaaaataatgccagattattttcatggggcatgtgaaataatttacatgggacacacgtggatattgctaccttagcaatcttatctagttctacccaaaggtatttaaaaaacaaccactgacgctgaagttatttgtaatcatatcagcagcctatctcctcatcctccattctcttcccctccaccagctgacttttgtatcaaaggcaggctacccttgcacttctcttttcacttaacatagaacaacagttactggagcaatctggttcccttaaaactagcgactcattacaatggttcaggatgtgaacttccctaaaaggctttgctctaaatcaaggtgactgtacattcccttttaggctagaaaacaacaaactatgcattcttagtataggattattcagcccatatattatatgagactacctcatatttgggtacctctctcattagttgggataaacaagtcttgaatttgagataattcaaaatctttgtaagccaaaggcatgcacacattttgcctttttctcattttaaaacccagtaacccaaaaccatcacatgaactacccaattctattgggcatacaaattttgttttctgatttccaagtctgaaggttcaggtcaatatttgtccgtaattaacatggacataattaatctgctgagttaaatgacatacaaatcctcaccaccaagagtgtgaacttgcccataaagttgtcacacagaaaattgaattcaatcagcttactttaaggaaaatatactgagttagtggtagacacagatggcatgcttcagaggattttggccttaaggtctaagagacagtgactatgttttcaaattttgacacaatgcttgtgacaggcacttctccctgtattgaagccagaaaactgttaagagccaacatgggtggaaaagaccagttttctttttttctttttctttttttttttttttttttgagacagagtcttgctcagtcacccaggctggagtgcagtggcgcgatctctgctcactgcaagctctgcctcctgggttcatgccattctcctgcctcagcctcccgagtagctgggactacaggtgcccgccaccacgcccggctaatttttttttttttgtatttttcatagaggcagggtttcaccatgttagccaggatggtctgatctcctgatgttgtgatccgcccgcctcgacctcccaaagtgctgggattaccggcgtgaaccaccacgcctgactagaaaagactaattttctgtctcaagtcaaggctgattggcctcatgggtggtggtggatcagtccctaagccccggcagtaaagccaggggccgtgatccccatagtcactgcagctgtctacaaggtctggctgcagtcactaaacaaggatctctaggccacaggtacccccggcactggggaaagtgagtgcccaagcttacatcttaaacactagttcaggcctttggattttgagagacatagagcctcacattgtaagtgatccttacttcagtgaaaacatataatagagtcctattgaaatccattctttacaatgggagattactgctaatgctagctaggtgagtgattcatgtgctacctattgtaagtattaattcttcattaggtagcagtgtgattcagaaaatgttacatagggatatttttcaagctattccattaactaattaactgggatgcaacttaagttggaagattgtttggttgatgtatggaaggtacccctttaaaaaatatctatgagtagccatgtgatgagtgtcaagttcttgacagagaattgaaatcttagcctgctgcgaccaaaaagcaatactgtttcagttagttccgttgccacacagactgaatgaaattaaccaaaggctttatgttagacaatgagtctcttctgaaataatgatagcttttgtgagggcataagaagcagaaagttaagaaagagttacttatggccatacaatcacattaatttgtctatttaatgtgacttttagattcaagaacaatttctatacgatgttctagaaaagacattattttttcagaaagacttttaaaagcaaggaattaattagttactaataataaccatcatttaaaataagcaatggcatgtaatgtgtagaaccgggacttttggcgagaaagtgacataaagagtagaacagagcacttttgaaccagcagaaacttatttgctttatctcttagttcataaatgccattttcctcaatcatttactataaaactaaaactattctttaaaaacctaagtgatttctcattgttactgttaaaaagaaatgtgtgctatgccaaatacaattcaaatgaatgaccattttatgttacattttcatcttattccttcatttatgctagaaaataacaaaagtaaaaatgcaatgagaaaagtatcaaagtcatgtatgcagattcagttgatctctttgggcttgactatttggcaacatatgttggccagtttttataggaaatctatgctaagtgtatgaataaaacagagacaacgtaagattagacactagcttcagaaaataaaattttgataatacagcagcctatttagtaagaataaaagcagtctcttggagtgtgggatttgtatatgtgattaagaaatagagacaaggggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaagaaatagagacaaggaaacatgatagagatagaaaactaaaaaaatgataatttaaatctttaacagtgaatatgagcaaagatcagaataggaacctatttattatcatatctatatcctataactgaaaaaatttcctaaaaaggagaacacaaaaatgcttggaagattttcttggataatgcaaaataccctgggagttctctctttacctcttagttcccccacatttaaacttcaaaagacaatgactctggagcttgagagagatcgatatttaaaacagaaggcatatctataaatccccattggatgtccaaacacttataaaaaaagaaaattaaatttcatttatcaagggttgaatagttaaggtgtcactaagagaccaacttacattaataagttcaacctcccagatttttttcaacaggtccatcgaagtgtagccattaattagaaaggctttggtgtagtcgcccagttcaatggaatccagccactcagctacagaggtgggatggtagccatcatgcccaatgggtctcatctgtaataaagaaaattacattaggattaaactgtatactttgtgtcccaacaacagaatgcagatttccccttgaaaatttatttgacatgaagaacagatctttctggagacggaaacaaggaaaaagaaaacactttctgatgtgttttcacaattctaaaacattaataattttcacgctgaataggttttcaaaatatacacagaaatttccaatttagctgctagattaactctatatttggaagagctaaacatgtcaaacttctgtcatagacattattggcattctggtgggtggaattaaaaatgatgtcagttgaatggcattaaattcgatgcgaaagtcaccaggaagtgcactttcaacatgtagatgataattctcatatgcacagcaccaaagcatgtgaaaatactgcatgacttaagcattcaaagggaatttgtgcttatgcaagacatgtattggaggtagtgcaaacacgctggagaaacatactgctgcggtgaaccagtaaaggagaggcctttgggtattttaagaccatgtgttctgcatcgactctacagtatgttagacatgaatagagaacttgctggcagacaggcatctattttttgtcagctatatacagatttttaaaaaataggagaacaaagaaatgtgacagcaacataatgtttctgagtttaaattggagtgtgaaagtaatttaagcaagaggaacttctgggtttaaaattttgtatggattattctggtcctttagcttttatttgaaattgtagctgaatctgtggttcttggttttcgaagtgactcacttctaaaacttgggctgctttgcatgccacgccgtatatctaatacttcagtttttcaggagagctggcacctcatcaacctgatgggggccttcggtaaaattcacgatggaaacagcaaggctgggcaaaacacaacatagattttcctctttctttgattcaaagagataaatattaatggaaatttatatgattctgatttgcgagcagagaaaagattagtctgggaatcagggattcagattttaatcttaaacatggtaagctttctatcactatgcatggttctcatttttgagattctccctactccttcattttaaagttactttttctcttttccagttgttccgctccccattctagtttccatttcaaagtttaaatgttctctgttttattttattttttttgaaatggagtcttgctctattgcccaggctggagtgcagtggtgtgatctcagctcactgcaacctccacctcctgggttcaagcaattctcattcctcagcctcccgagtagctggaactacaggtgagtgtcaccaagcctggctaatttttgtatgtgtctctactaagagacagagtttcaccatgttggccaggctggtctcaaactcctgacctcaagtgattcacctgccttggcttcctcccaaagtgctgggattacaggcatgagccactgctcctggcctaaatgttctctattttaaagttagagtacaatttattatttacattagagtctgaacttggtcagacttttgtacttcacttttacattgactgacccattttagctactcattaaatatttgttcatgtaacacttaactctgtgtttattatgtggtagctacaaatgtaaatgacaactcagcatttgcagaatgaaagtcagtggcattcacaaatccctggatgttatgtatgtataagatcagaggctaggacccaaaagggaggctcatagatattcggtagcttcatattctatagagaattacaaaaatattggggctgggtacattctccaggcctcgttaaaaggtggttgaactaactctgttaacctaaataatcactctggccccaggaatcttcctgactgccccagtgacatgaaataagaaagaaagggaagaaagtgagaaacactaaggttgaagttaactgcttagtagggaggtcttgccgttggcccatccataaagctgaccactccagcagcagatactcgggaaaagcttagggagtcttgatgactggatttgggtcaaagtcagttgtctcataccagtgaactgtgcaatggggttaccacaggttacccccaagcacttacacaacactcttttgaggaagcaattagtggccatctgacacacagagggtgttgatggtcggtggtggccaaagaatcagggaacccatgacaggactgcaaagaaaatctaggtaagtacaaagatgtttgcttgtccctccaatccccctttcttgtcccaatgccagaaaatttagaatcagaagagagaagtgccagtcccttaggggaagtctaaacttgggggggggggaggtggtgaggaaaataaaactggaggtttcaaataaattggaactgagccttcaacattttacatggttggaaagttattggaaatgtctgagatgatatttataaatagtaaagggagggtcagttgagcttggttgaatgattggaaaataaaaaaataaaataaaacagcaaccatcatatcaggattgcacggaatgcaggctgttcagtggtctgattactcctgtaaggcaagttctcctagaccaatcttaaagaggtgagagggagggaaatatttggtgggaggatgaaagacaagggcagggtagagagcacaactgaagagaccttggaaatgggtatgctgaggtgtacagggcagtatcatccgcccactcattcaataaatatttaatcaatgcctattctgatgaatgttgtggaaatggtagagaacaaaacagtcatagtctctccctcatggagattataactcttaattaaaatatgcaaacagatgaccaataaattatgaaggttctgcatacctgaagagaggaaaccattagagccaaatgcagttacaaaattaacttgacacatatttaatgatatgcagaatagttactgtgctgcacaataatttcttccaaagcaatgatcccatctgttcctttatttctgtccctactgccattaccctgtttaggttcttgttagtgcttacaaaaactaacacaatagccttctacatggtctcccacctttgatccagcttgtatcttgctactacattagtcttcctaaaagtcagacccttaagtgtacctttgtataaaagcctgtagtggctccttctcgaaaaaagtccaaatgtcctattccagcattcaaggccgattgagattagcctaatctcccactcctctgctattgtgtacccaataaatgtaactagacacgtgtatgtctaaacagtacattaaatcgctaggcattccctgaaaatgacctgtatatgacacagtcaatatctttgctaatataacttcccatgcttggaatgcttttgcccctgcttctggagtgatttcttcaggactggcttctcttcttgagctctgagatgcaaatttctaaccatttgtaggacatctcacataaatgtcctataggtgtcaccaacataagtcaaaaacaaatttaactcctttagttcaaaaacaggctctcttcctctttttttccatttcagttaagggcaactattactccactgcccaagcagaagcttgggagttatcttactttcctctttctgtttactatcatatctaattaggccaacatggtctatcaatttgatttctaagatgactctcaattcatttctcttcttccaaaatggactttggaatatgacattcccagcagtgctacgtatttgttgggtgatctttggcaagttactctttcagcctgtttcctcttttttagaataagcataataatacctattccaagtgttgttgtaaagattatatgaaatagggaataaaaattgcctagcacagtgatttgaatataatagctattcaattataactcttagttctcttttctccccattgccctaaattagacccatgcttattttgaaattgcataatattctgccattggctgctagtcttttcagcttccaatcaaagctctcctctctcatcccttcctatttcctctatttccttccttctttatcttgttttagaaatggtttgcatctgctaacatctttacccctctccccttcagccgacagttattttttagaaacatatctaacgaggtcactcaagtcgattgaactgtttattccaattcttcgttctcttactgtattagaattatgcccctgtgccctttgccaagggatcaacattatgtctcagtgtggctggagttacttcccagtctcatcaatgctggccaatagaatgcgtgaagtgtcagtgtggtggttagagacgaggtctctgtgctcctgtgttctactaatctttcagtgttcatatgctctctcataagaatagcaagtgctgagaagttgcataactcctggttctaggagaaagatgaagactcgtggagcaaacctaaatttaacccaaagcttggaatctaccctagctcgatggggctcaggaaagtccagatgaagttagctgaagcacagcagacccgtgagtaagaaaaaaatattttttgttgttgttgctgtgaactactgaaattttgattacagggaaaaactgaatagtcactccttgtttaaaaacccttggtgtttatccattatgcctgtggaatataaatcagaccttttagtttatgaatctattggcaaatgcatcttcatgagactgagaaagattagggatgctgaataagcaaacatcagtatccttcccaagctacctcactgtcatgcagaaactctgcatgccacatcttttttttttttttttttttttaagacagagtctcactctgtcacccgggcacccaggctggaatgcagtggtgcaatcttggctcactgcagcctccgcctcctaggttcaagcaatcctcccacctcggcttccctagtagctgggaccacaggtgtgcaccactacacccggctaattttcttttgtatttttagttgagaccagggtttcaccgtgttgcccaggctggtctcaaactcctgagctcaagcgatctgcctgcctcaacctcccaaagtgttgggattacaggcacaagccactgcccctgccctatatgctgcctctttattaaccctaaactaagtaattctttattgtatgagtttgatttttggggcataatccactgtacatgtaatatacctccacatcttcgctcatgccattccctctgctaggaatacagtttctactttttctcctaatgaaattctatctatccttttttttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaattctatctatccttaaaaggtcctgtttaaacgttacctcctgtgtgaatctttctctaatgttaccattattccaccgaaaaatcatatcttctgctatatttctgtagtattttccatagagttctattatagtattattaaagtctgctttcaataatagagaagtgagtatctgtcttcttcattggactgcctaccccttggtgaagaaatgaggtgttaatcatttttgaagtccctaaatcgtccagcagagcatctcacatatggcaagcatatgctaaatgtttgttaaattaagtgacttaatgaatacatgaagacaaaatgacaaattcatttcagtggcttggtatccatttgtgggagagatttgtattttgtactccatgttatgaaaactaaggttatctttttctgcctaacaataacattcataactatttaaaacctccatatatcaagaaccagttccagataggatattgtgttacagaatgcaatggactttgtttccatagcacagaagacttgattctattagccatgtagccatgggcaagtcacttcatctctctaagcttcagtggtgtcagctataaaatgaaggtattggaccaaggatctcaaagctgctttgtaattcctaaattttgcaattccatgactcgtaaattaattttaaattagtaacctatttgtttacccaggaaagaaaaaataagcccaaagacaaaactaaaattcatatatatatatatatatgataggacgtgtagactaaaggtcagatggcattcacatttctttcatgtatcttcagcagtacccacagggagcactgtgactgcattctcaaattagcaatgatgaaactttttttccagcgggaacatctggcaagacagggctaggaagtgacagctccatcggcctgccaggccagcagtgctgctaagcatgaacggaagtcaggctcactctataatctgagaggcagagtggtgagcaggcagcaggcattcattacagaggctcgcaacaaggcaatttgattcaattagttgaattccaaagtctggaaaaacctaagctgagacagaaattcgagatagcagtgaagctttagtcttgggaaaattgagatatattaacatattttttttttgccaaatgccttccttgttcttgttccacccaaatgactttcctccaggagttttttagagcatacttggcctcagagagagtatgctgttaacatcacaggtggtacagcaggcagagaaaccacaggacagtactctgtggagttctgggtttgagggggtcagctacggggcagctgaacaacccatgctctgagactgcttgatcgacttcaaccagagtaactcttattttatgcgttttatacaagtaagaggaagaaaggttttctcggctttaaaaagaaatgtttgaaaaccacgaatctagaagacttttgtaagattacatgaccactatgattttattttctcttaactttttagctttatttgaaatattatggatctgttatatatatgtggttatatatatatatacacacatatacatatatacacatcacacacacacacacacacacacacacacacacacacacacacacacatatatatagagagagagagcctgtcattccatcattctttctctttgcctgaagccagcattttctgtgcagataaggataatatcttatgagatgacggagccacaggatggaaggtatagcaggaggaaggcaataaaaacaggtaaaaaaaataaaaagagagagaaaggtgatatacattataatagctttgggattaaatgagaaaagtagttcttgatgggacaacttattaacctagaattatgatattggcatggtatttagaacaagaggataaggaaccctgaaaagccaataatggattagacaggcatttttatgtccaaaagtgttagaaaattgagaaaaagactacttgttgttcccttaaacttgtcctctcttcttccacataatggggttaaattgggttcatgcctgccggactagagacaagatacatcagctttttttctggttgctgctgtgaaaatatggttgagcctgtggaatgctaatgaaagtgttgcatgtaactttcaggtcacctctagctaaaagaagttcctcgacctagaattcctcttttttcttcatcttcctataagctggaacatcagtgactgcagttcagctttgactacacaggcaaaacaataccctggagtctgggaaatgcttctcagacctcaacgtgcttaggaatcatgcagagaatcttattagcagacgattctaattccgttatttggagggaggattggagattctgcatttctaaccagcttcctggtgatgctaatgctgtcagcccatgaaccacactttgagtagtagtgctttggaggatgacagaacaacaaatagaaggtcctcggtccttccacaattgcatagagcaaagccaccttgtaaacctgcactgctcatttcaagactattatatgagagaaattaatattcgattctttaaaccactatattatgaatgtctctatttcagtatcatagcctttccttgaatacaaacataactaaaaataaggcagtttcatgtagaacatttaaatgaagcctgtacttccatttgacattacattgtattatctcttgttttgtggggccgtaagttttcacatctgttatcgttaaagaagcttcatttcctttaactgtgtttgttggcatttctctgtcaatcacagcatcatccctttgtaacaactatgcaagggataagaggagaaaaatgcagggaaaccccaagtttctagcttggatatctgggcaaatggtggtgttaccaggtaaaagagaaaagaaaatagactgggatgacatgaataattttgagacatgagaaatttaagatgctatgctgtggaatggcactttaaatttggagaagtctggggagacacgcggccttgggcatcatcaaagtacaggtaagagtgttggcaactccacttattagctatctgacctcgagcaaatcactcatacttcctaagcatccattttctgattagtaatgtgaaagattaaaagaatatctatcgctgagcgttgccatatgtattcaatgaaactacacaaggagaatttagcacaatacttggcacacagaagcactcaataaatctttgttattttttttctgacagctgaaatcatgcacaggtaggactgcagaggtgactttgtagtgtgagaagagaagtggcctgagaatgaaccaacactttcaatgcataaggaacagataaaaataatactcaggagaccaaagaaggaatggtcaggacaagaaaagaaatgggggaaataagagtgtcaaggagagtgtggtcagcagtgaggggatgctgcagagacgtctaataaaatgatgaaggagaagggtttgtgggatcacaaataggtcatcggaaataggtcaccagacaccttattgagaagagcacagaagctgagctgccctaggttggggagtttgtatgggaagaaaagggggagatgagattttagaaagcacagaggaaaacacatggaaaggggtaaagaaatgaggactcagggttgagaagggtcagagtcataaaacagttaagttccagggtgcagtggagattgcaggggagggcttgccttttgctttgacactttgccctcctttcttgaaattacggatctgacaaggatggttggagctaacttcagggtgaatactctgtgttaaaacagtgcgagtgtttggaagctacatggtttagacttggtgagagctggatgcttgtacgtgaagtacctgtgaccttctggtgaaggtcctcacgtgggcaagagctgtcgcctgtgttgtcttcactcctcagatacaaacacagcaacctatcatttacatagacccaccagtgccgatatccctgatgtgccaggctcagctacttaaacttgcctaggaagctgccgtggaccgtggcttctcttttcccacctggatgtactttgtacactcagatttcctgcctgatatggcttttgtaatacagatagctgatatcgtcaggtacttccctctattctggctccttgttctagactcttctgctctgtcctgctgctacccaagtcttggactaacagcagtcctgaaaataaacgaggacaagcagtgctagcagacagtgtgctgccaagtccaaatgcaggtctatcaagtagtgtgaggatcaaatctacaggctgtgagacctgggcttagacatcactgtgctgtttcatcagtggctcttaaaaggctgattgaacataaaagagaaaggctgatcttctgaccacgaggccccagaaaaaagtctacctatcaccatctgagtgctatctacggcagtgcaactttgctgggagggacgtctccaaaatgctgagcactgttaatgataagaacatcacttaacaatgatgtgggactttaaagagcctcaagtgatttcacgcatgtcacctcagttgtaaagtgttttaggtgatctttaggaagacaccctttaaggagtctgagagcctgagtatcccatataattatattccttctgtgggaatggaaaggattaatatactgtgactgttgttggaaagcaaggagtgataaactctctgtgttgtgcatctgtagcaagggaggtatacatgtacaaatacgtctgctacttgcagctcctttgtttacaattagactctgttatggatacaatttctataaaagaataaagagaaacataaaccctcagaagtaagaaaactgtgtctgatgtcactacgaactcacagctacagaaagtggtaacccctctattatttttcccaccactgactgagccttactgatttggggttccttgagtgttcagatattgaagactcccagctgtaggcataaggcagaagcagtgaagaagtagtatctggatattacttgatactacatttttgggaaataaagggaaaggaaagtgctttggactagacactgtctctcaatgttctaggttttctatttcgtgaaaaagagaaatgaattaaggtctattccagagagggcctgaggtatccctaattttgaaaagtcttagatcatggagtaaaatagaagtgaagcaatggacagcaatgaaggactagatttaaaaatgttttcaagacacataggggatcagcttccaacagcacagaatagcctagaagcactagactggccctgtctctagtcatcagggataggggcacgccctctggacaaaggcactgggaagactacaagttaaaggagttaagttgccaatgcagccaagttctataaagcatccttgggaaaaaaggtcaaccgctacagcaacaactacaaaacaatctgtcttatttcaagccgtgtgtgagagctactagtcaggcactgctctttttagcttcatctgtgcccagggagattaactctatctgtagcagcacttgagaaatgctatctgccatgtaggatctgtgtgggatgcagatgaaaagaccagtagagccctaacacagtagacatataacatggtccttggggttgaattattttattgaatggttttgttgtacctctccctgaagctttgcgtaaaagaggtgtttttaaaaatttaataagaggaaatgtttttaccatcttttcatttctaaaattcttgttgaggtaatgttgaccctagagccttttgttaaacatcgttatttgttttgatatgtttccttgttgcaaagctttttttatgaagcaagagttcagattaaagatgaacagaggatttactgcaactagaataaggcgctgaacaatgttcactagcattcacatttccaagctctactagtgatgtgaactatatttagaaaaaagacacggggtctctttttttctctgacagtacatgttttctgtcattcatgcagctatttggtggttatatagtacactgctttgctcttcaaacagaaactttaaatgctactattaatcaggaatatcatttgcatacttttagtctcaactaaaataatttccccaaacttgagtcttcagaagataatgaatgccctgaatgtcaattctatttatttgatatttaaaaaccatgtcctttctcagagcctccaggcacatgcataataacataatccacagaagtacttcaagcagataaatgtaccacacaaccagaattagcagtacacaaatgaatgacttatgttctacctgggtagagcagtacaaaatatgtcattcacatggtggtcaaacaggagtatactcacgttcacttagggagttacaaaaatgaggacctaccatccattccattcatccatccatccatccatccatccatccatccatccatccatccatcccatccatccatccatccatccatccatccatccatccatccatccaaccatccatccgtccacccacttatttactcaacaaatactaacagtatgtttgctatattctaagcactgttctggatgtgtcagtgaacaaaacatatgaaggtgccagtccttgtggggtttaccttctaagtggggaagacagataataattaataagcataataaataaagtatatagtctgttagaaggtgataagtgctgtgaaaaaagagaaagtgcagtggggggatcggaagtactggagtgtgtgtatggtgtggcaggtgcagtattaaatagcgtggttaggggaagtttcattcagaggagaagatttggacaaagatttaaagacagtggattggctgggcacagtgactcatgtctgtaatcccagaactttgggaggccgaggagggcagattgcctgagctcaggagttcgagactagcctgaacaacatggtgaaactctatcgctactaaaatacaaaaacccagccaggcatggtggtatgtgcctgtaatcccagctactcaggaggttaggttgaggcgcgagaattgcttgaacccaggaggcagaggatgcagtgtgttgagattgtgccactgcactccagcctgggtgacaaagcaaaactctgtctcaaaaaataaaaaagtaaaaaataaagacggtggattggctgtgttgagggtgaagatttcaagtagagagaacaactagagcaaaggccctcaggaaggagggtccagcatatgttcaagaaataacaaggagaccaatggggttggagcagtgtgtgtgcacagagaagagagggaaccaggggccagataagtgagggcttataagacctggcaaggattgcctttcaatctgagggaaatggggagtcagggtatgcatttgagcagagttgtgacatgatctggcttacatttcagcagaatcactttgactgctgtgttgagtaaagctaataggtcttttcagaggctgtggaagtaattcagaaggaaggggctagtggcttggataaggtactaaagtaaaggcagcaagaagtagttagattctgggtatcttgacggtagaccagcataatttcctgaaacacaaaataaaatcatccttgttctctaacatggatcaggaatctgtcagtttggtggttgcagctgtgtgtcatgggtctcagcttgaagaggactgtattcgttcatcgtgtgtgggaacatatgggtgactggcagggacaggcttgcagcagtctgtgctcagtgaggattccaggggcctggaaagactctgctcagagattcaaggaataatagatgagtatcagagagaatgggtgattctgaatgattttaaaatctggcactctgactgtgccctggccagtctcccatggaccatcccttaagatgaagaggtttcaattaaatagctgtatcatgaaacatttttggacattgagaacaaaaggagtaggcagaattagcaccagcaactttgtcagcaagaagagatggtgccatattgcagatattggtgccctcaacattgggcaccagcagttggcaatgatggccactttggcaggcttcagtggcattggcagaacattcagttggcattggctaaggtgcccttgatgggaagacactgggtatcatagccagagacacagacatcagtacctttgacacattgggcacctgcagctctgaagcagcccttggcattcattagtggcagatttggcaccttcagtgagtatgaagaggactgagagcacttttggtaggtcctggtggcactgtctcaagctgtggtgacagaagacatcaccacaataggctagagcaagagaggcagaaaagggcagatgtctcatggtcagcggtagtctagttaacagtgcacatgtgacaggagacactttgaatgaatcattagaaggaatttcagtaaggcctagaatatgcagagaagtgttgctctatgattgttgctgttatcctattttgaagccctggttggagttcctgaaaaccccttttatatttatagttaagggataatctaagaactattccactaccattggagtgagaacagcagtcacaacaaaaaatagcttgatctttaggaaaatgtttccagcctcatagtctgttgtatgtgcgtgtgtgtgcatgtgtgtgtgtgtgtgtgtatgtgtgtgtatgtgtgtttgtcagtctagaatttctaattatctcagacaatggagtgactaagaatcttcagctctatttatgggaatccccagtagagtcactcttacaatagttttagtagttattatttatttaattcaataagaatttttaggcactatagtgcatcatatgtataacatcattctagatattgtatatctaggacaatatatatataacatcatcctagatattatataaatgcaaaagggaataaagttcctaccttccaggaatatgtaatttccttgggtatacatttgaaatacatgcaaataaagttctgtgtcacttaacaacagggatacatcagaatgtgtccttaggtgattttgtcattgtgcgaacatcagacagtgtacttacgcaaacctagatggtatcacctgctaaccatctaagctattgctcctagtctataaacttgtccagcatgttactgtactgaaaactgtaggcaacttaacataaattactaggtgatggaaatttttcagctctattataatcttatgggacctcttatatatgtggttcatcactgacccaaatgttgttatatggcacatgactgtatacaaagataagtgccagtttttataagttctagaaaaaaatgctagagtggattggaaacatttgggtgaatttcttttatagtttctcttggggttaatatatggtgaagtaagtgattgtatgtgtgcttgtgtgtacatgtttgtcagagagagggatgcaggtgggaggggtggggggcagagagagagagagagagagacagagagagagaaagggagggtgaatatggacatccatttctctttattgtccctagtcctagtcctagtcctagcaggcacaggcagcatcctctgtctgaagtgactccttcaatgtcctagttggctaaaaacacctgttcattctttgagattcagttcaagcaccatccacctgcccaaaaagctttccctgatccccatgcatttagctcttctctcctcttgtagcattttccacatagtattctagtttttgacatatctatctctgtctaaaatgcaggcagaactccttgaggcagggaccaagtcttctccatgtttccattcccatctctggacttagcatagagctgaaatgaatagacagtctgattgaatggatggacaatgagcaatttgctaatgaatgtctgtgcatggccgtgtgggtgtttgcagacgttatgcctctggagttgctctagcttcctttcatctacctctgagcctgctgggtctcgggacacaaggtaattgttactttatgtctacatcacgtggcactcagaaaagtgatctggctgaagtgcatgataatgtaattgagtcccagaggtgacaggcagggaaattgatctctctatatttactgaaataatctcttgtacatctgtggggaaaatttcacattcaaaactttcttatgatacatttacctcttagtatttagaaaattgtaaatacaatcctttgccaccaagcagtagcttccaagtaaagaaggggttgagggttaaaactaatataatgcattgaagaaaaagcttttaacctgtcaggactctgtgattcataaattataaccttagaaatcatttaaagtgtatccatttagcacttataccttcatgaattcatggaacaacaagtaaagctaaaatgtatttcctcttgaagacatgaaagaggaatcttgcagtttcttgggtactcgtttcctttgataagggcagtagttatctattaactgaatgtctatttactaaaatacaaagcaatagacttgtgtgaaatagtaaaaatggccagtcattttttccccaagatgagtaaattgatgggtgattccacagagtacagagacggggcactccagtaataggaagtagaggaaagcagttaagggcatagactctggagccagcctggccagtttcaatcctgactctgacacttactagtggtgtgacctcaggcaagttacttaacttctttgagctttaatttcttcacctgcaaaatagggatttaattttgagatttaaatgtgttaatttagagttaatctgaagtacttagaatagtgcctggcacgtaggcaattttctatttaagtgattgctattaacataggggtttggcccagaatgtctttctggcatgctgaggaacatcttggggaacgtgtattctttagatagagttcactatggatccacagaagaccaaccatcaggctagaacccaaagccaaaggataggtggaaggactactggtttgaagtagaaaatctcattgattaccgcccctcctcatcccccacaaaaataaccacaaagaaataccacgtaatgaaacagtgcttagcttagggaaggaagaatagtaactatgtcacttgtttagcctgcttcattaagctcactataggtatttgtttgggtttgaaatatttgactcattatagcttgaaggacaaagtgatgaatgaaatttatagctggattgatggcactagctgtatttcagctgtaataaccagaggatggttattacgaatgagaaaaaatagcatctctatctgcctgttagctaaacatatgctttggatcactttttgcttggagtgtcatgagttatcacaaacttccacaacaaagaagttttcttttttaactttgatctatgtattatttgtttttttagagacagggtctcattctgctgtccagactggagtgcagtggtgggatcatagctctctgctctctaactgctgagcttaagcaaagctcctgagtagctaggagtataggtgtgtaccaccatgcctggctaattttttaatttttttggagagacagggtctcactatgttgcccagccttgtcttgaagtccttccctcacgcgatcctcctgccttggcctcccaaagtgctaggattacaggcataagccaacacgcccagccacaacaggtaagttttaaaggtacataggaatggctttttgattcatctgtctccttctccaggaacctactcctgattccctgaacagaagagaccttcccttttacttaacgtacaaaacttgttatttttactcctattatagcttgtttcatgttctgacttgtactatattaagatcatttgcatattggtctgacttcctttgctagactaaaatcttcttgaaggcagatactgtgtaatttcatcttatttttctccttgcactgtgtcttgggacataagtaaatgctcaattcatttgcagacataacttgaacagaaatatctcacttgaatgccattgatggaaaataagaaatatagccaaattctattcaacaattaagttagcacttatttcaattgtatggtaaaggcaggtgacaatgccttattcaaaatggcgaatatgctgttttacagttttcgtgtaaatgcacacagttctgcttttctgtgaaatcacaatgcctttagcaactaaatggaactacactgtcaagatctgactgctcagcttctcagttcacttccattccattctatgctatgtatatttatattgagtccttgcttctaagagatgcagacaggaagatctctctgtattaggcttattcatttaatctctctcttttttttttttttgttttttgagatggagtctcactctgttgcccaggctggagtgcagtggcgggatcttggctcactgcaagctccacctcccgggttcaagtgattctcccgcctcaggcacccaagtagctgaaactaaggtgcgcgccaccatgccaggctacttttgctatttttagtagagacggggtttcaacatattggccagggtggtcttgaactcctgacctcgtgatctgcctgcctcggcctcccaaagtgctgggattacaggtatgagccaccgtgctctgcccatttaatctcttaaatagggaggcatgagttatgactttaaacaccttctcttctagcttctgatggactaaacaataatctttaaatacatttcaaaattatcagtttagtagatgacaatcaaattggaaagttttgccagtttcttatctagaaaatgaataactgcactgtgagaaacccactagctcagagtagaatgttcactatgcaatgcagtcatgggcatttttagtcacggactctcttaggtcagtaattgagttcttttctgttacttcttggctccaggcaaaagcaacatcaaaaatgtattgatttttgttaatttagggagaatttattgaacaaatgcaagtggtcataactaatattgagttcctctaaatgtcagaaacttcatatgcatttttgtatttatatctcacaatgacctaatgtgataagttccactattatctattgttttatagataaggacactgggattagagaatttaagtaacttggccaaggtgacacaagcagtaggtggctaaactgggattaaattagatttaactaaaagctcaagagagttattttttgagcccctgcaagattgcaagttccttaaagatgacttaagtggattatttagcttactcatctcattatccccttagtatccttagggtgctttgaagtacagcgtttagacaatacagtggggtggttaagaacctctgttaagccgcctcagtatgaattctagtttatccacctaaaacagcattcacagattcccatcattttctgtccatttcttgcttaatagttctccatagcatttatcattacctgaaattatatagttttacttctttttttctgggtccctcactagaatttaagctgcacgaggacagtgaccttgtaagtcttgcttcctaacaccaaattctcaatagctagtacagtgcctggcatgcagtaagtggtttaaaaatatctattgaatgaataaataaaaggagatacattttgcttaccgtttatgcctggagtcgtaattttcaatacaattaatgggccaaatgaaccctaccttttttcttggttcagcttcaaaccttctttttaaaagtgtatttaatagacactaatatagcacatatgctttggaaaactccattttatgtgctttacaaatattgacccatttaattctacagagaaggtgaaatcattacatccattctaaaggtgaggaaccaggcacagaaagatttagaaacttgcccatggtcagacaattaggcaaagaatggagccaagattcaaactcggatagtctgaccatgttcccaaccattccattatgctgcttcctagattaatcccataaaaatgtcatttccctggagtttaatgctctaaagatgtgtctttgctctcttagagaatgaccttccatcttgcctatttttccttcctctctacccagattaagaaggaaaataaattaagattattttacttattgaaacagcacagtatgctatcagtgaagcttctctcaggctaccttcaaggataaataagtgaatgaccccggtggctgctggacagctcacatggcctatatctgcttttcttctttttcatatttgtctttttcttgtatttctagagctcttggattcctgctgcaacccttccttctagccttgagaagggagttcagtggtccatggaggctgcaaaaactgccttttaagcctgaaatgtaaaaggaaggccgattttataaatgattcctgttcttgcttttagtcaattggttctttcatttcctgtcccttttcagtttctttcacaaacacacaagcaactcacagccttgggtctctgatatagcaccatattcactcaggaggcaattgtcatgagcacagatatctgggatttagttccagttcagttactaaggagcaatcttccttggggcaagtcatttaataggactgggacttagtttcctcacctgtgaaatgactccagtgagaggaagagctggagatttaaaggtcccttccagctctaaactgtgattattctttgacgaattatgtaaggaagggaaagtgctcagatatctaaagccctatttctctcactacagattgcaggataactccaagggagccactgttctttattaaatgggggtgaacttctcagaattgaaggatgacggctgctggggatagcaatagatcagaacctattttcctgcctaattccttccctatttctctgtaaatatcagaaggagattaggagtaaaagtgatatttcagctctgtggtctacataataaacgattccaagataaattcttaaaaaaaaaaaaaacactaaaaagttctgcctctttagcttgggaagaatgtagtagccatcttgctttgtgaaactgcacaaaaaacttggagcagagcatgggtaagtatgtttgaattgcgtgctctcacgcccagcagttgtttaaaaatctatccagcccatacagttattgcgattttgcattttgtacatatggggctttgtcatttcaaagggtgcaaagagcttcatgaacaatggccattccttctctcgatgtgaccccgtagaacagactagttattggtcatcacttgtaaacaggaagcatgaatctcaccctaggaaatgcaggccgccagtgctgtcatgcttacatgaaggacatgccttatccctttgtaaaacatttaaaaataaaggcactcagtttggaaatatctttgagcatcctaacctgacccattcagaactgacctctaatcagcatttttgtttggctcagtccagtctaataaatattaactgggcattactatgttcatgatctgtgtgctccatacctaggaaaggaagatgaacatggccaagatcctaatcttgagtaagagacaaattagtcaacaggtggtttttatgaggtgtaatgggaacacagaagggttaaatcatctatcccagagagaagatgttgtaaagatttctccaaggcttaagtattaaggaatgaataggagttacccatgggaagaaggatgagagttaaggtacagaaggagatgatgtttctggcacagaatgactagattctcaggaattctatcacatattcctaggaagagagataatacttcttggcctaatttgcagtttaatgagggctatgaacctgaatcctggtgaatcaaatgtgatttaaagtaagtgatgcatttcctgtcctggcaatagaacatcccaagtgatcttctatgttcctctctaccctgctgtcatggcagcccacaaagaactccaggatggaagggtccatgatggaagaagccagggtccctgaattactggttggaggagagctgcctgacccacactggacttagcatgtgtgagaaataaatttaacagtgttaaaccactgagaatttggagctgtttgttacagtggctaggttcattaccctgatcatactgtgtgccaggctaaggaataataaaagggatctgaatgacttgctgtcacttcaacatttatatagcccaaataacttaggtttttgaccttaacattgattactctttcttcctttctcatccaatggcaccaatgatttctttcttaaaaaggtgatcttttacagtctttcagcaagtcaactgctcctcctgagtatattatcagcatcttgtgtcttttaatgacatttgtctattgtatataattatataacattatatctattattatatctattattgtataacatatataatatacaacaaaaaatgtattatcgtatatataatatatgttttatattatatatactatacatttgtattataaaatatatatcatattgtatataataggttataataggaatataatatgttaatgttatacaatatagcatgtatatataatgaaatatcatttcaaaggtatctctatataaaaatcaatttttctcattagaatacacattttatgagggcaagggcttcatctatattactcattactgtaaccctagtgctaagggaaatgactagtatatagtaagcactcacagttattttcagaatgaatgaataaagataaatataatagaatagaggctgggttttttaaaagaaatggacttcagctgtgttcagatgtaggcgttctgaaggcagaaagagctccaaacccagacgagggttgacagttgctcatatgaaggtgatagcagaagctatgcaggcaaatgaaggcgcctcaggagggtaagggaaggaagaagatgagagaattaaggctgaattttagggaatatcaatgtataaaatagactaagtataagcagctaatgaaacaatattagaaaaagtaaggaaagtaaagagagtattgcggcacagaaacagaactctgtaagaatcacagttttggggtcagatctgtgagtacagcatattcaataaacacctgtctattgattgaaataagtgctgaacactgaatagcatatagtcccatgaagatggtcaaaggggctgactccttttctaaaagacatatagccaatgtcatccctgttaattatacacatttctctgggatgacatcaggaggcttgggttaccctggggcctttcactagtctgataaagtaggctatatttctgatctgagttcttccctgtttagaagattctcagaagtatggaaaagttcttaatctagctggatatttattgataagttacgggtcagtaaactatgcctacagtctaagcctggtctattgcctgtttttttaaataaagttatttggaacacagccacactcattcatttctgaatcatctatggctattttcactctgcaacagggttgagtaaccacaatataggacatatggccagcagagtataaaatatttatgatatggcttttcacagaaaaagtttgccaacccctgagcactgagcatatctgttttgcacccccggcaaaaaaacaaaaaacaaaaatacaaaaagcaaaacaaaaaaaaccccacaagacattttcagaactgagtggagcttgtaagaaccctgggaataccacagcctgtcttactaaggactggacctataggaaatagaatattctgtgccttcggtgagactgggtcccgtcatgtatttactttaggttaggacctccatgctaacagtgcacgtatgtgggtgtgagattctctttgaccgtgtatctttaactgatgtccactgggtggtaggccaacactgagtggcagtgagtttaagacatgcaataaaaagaataaaaagaaatgcaagtgaaaagaatgagggtagatggagagtgagtgatgggatgggagaatgaaaataagtcgccctgtcaaaaggtaccatgagagcatctatgcctgtgggctatattttgtcattgcccttctgaaaaataccagaagaaataagaacaagtttctatcatttttctaagtgacagggaaataagactgaaccttcctttctagacttttaaagaaataacattggttgtacacttttccgctaaagcgtacacacatctgcgtcaaccatcaagcctagaatcaataaacatctgaatgttaaggacttagagagcactagcgtctttaagagaatgactctgttctcttgaagatgctagttctttcaaggtccttaaaattatcttcatagaatgtctctgttctcttaaagactctagttctttcaaggtccttaaaattcagatgtaacttctttgaaagaatgtcacattcctaatactcctttcaaaggctgaaataacctgtgatctcatcatattaagacatttctagagtgattctcttcatctatgacataggggtagcagagtgacacctataaccaaatctggcccccaatgctttgttttgttaacaaagtgtttatgaaagaaacccacagtttttttggggggtgaggaggggcaggacttctgctctccagtgtgccacagtttccaccactccatattgtcttttctttaaaagtgtttgagttttcaatccctacaatctctgcccacaccattttgagggggccaactgttgctttgatctattttcttcgttcaggcctaaaattaaatgaccacttgtaactttctagctatgttagtttattagaacccgttttatttgctaacattcttcaagttttgtccaatagagtttagtagactcactgacctaatatatatggtaaaatactcttttcagtaatgaggcaacaatgaagaataaatacattttaagaaactgtgctgttttatgggattactgatttgtgtatatcacttagatcagtgatgttcaggttatgaagtgattatgtacaatttgcaaatatctagtgtccctaacttctgtattatcttatatcatgctacattatacctaactctacagaccagagacatgtgcctcttttttgagtggcagtagcaaaggtggctcttaaatcatctgactgtgaacaatacagtcccaggaagatggcccaaggaaataaagggtgtttttttccttgtagtttttgacggattattccattttaactacaaatgtggacaatggaaactaggctgtaaagtagatcattataaaatgtacctggccaacttctaagatgtaccccaccctgcccgccctaccccatggtccccaccgtctggtattcacgcccttgtgtaaacacctctattatgtatgaactgaatctggtgacttgattgtaatgaatagaaaatggcaaaaagatgggatgtcacttgtgtgattaggtagcaaaagactgtgacttccatcttgctagcactttcttgtcttctcacttgcttgttctgttgaagctagctgcatgttgtgagatgctctatgtggtgacaaggaactaagggaggcctcagccaacagtgtgtgaggcactgaggcctcagtccgaaaatccctaagagcctgaatcctgcctacaaccatgtgagtgagttaggaagtagatcctcttgacttgagtcttgagacagctgtagctgtctgaaagatccagagacagaggacccaatcaacattgtacctggattcctgacccacagaaattgggagataataaatgttgttatatgccactaaaatttggggtaatttgttctttaacaatacagaatataaatcatctattggaataacagcaaaaatttttttagccaaagcctcaaactgaggatagagaagggggtaatttaatccattcattcagaggttctcagtgccattcagtgaaaaaaataaatatatgtagctccaataaatattggttaaactgagcagaactcagaagtaaagggccactaaaattcaggtgttcattatgtagtaaagtaacagtagcaatgaacaaaagtgaataccagacgtcgcactaagatcaagagtcctgtgataacaatatttactagtcatcaaatatttttgggtttgagttttgaggaactccaggatttaaccgaggagaatgagtaggcagagagacaacagcagagatgcagagagtaactacgtattgtggaagccgaaagaagacaatgttaatagtgaaaatttgccccatggggttaacaagaatccttgagcttgccttgcaagaagacagacgaagaaacagcttgttataattctctctgcttgcaacaaaactggctgactggctgaaactggctggaaccaataaggctgactggagtcagaatggcacagaatagactcgctctcctggggggtgacgttttgatgtcacagcctgaatttccacgtcatgtttcagaccagttccccatgaatttgcacaggcaacccacggaaaagcacgaagggacaactgcgcatgctcaacggactttccaaacttcccattcctttctgccaatcactaaccaaccgggaagccccgcccccagaatctctcccttaaatataccgctttaaggctggtacagggcgacggatttgaactggattcctgcctccttgcttggccgccttgcaataaacctttctctctacaaaatccagcgcttcagtgtttggccgcaattgtgtgcaggcaaatgaacccagtttggttgataacaataattgtcaatagtatcagagtctgctgaagtcaaagtagggtggagataacaaagggcttatggaatttctgatcttctgcttactggtgaccttagcactggttgtaggaggtcgcagcagagaaacaactcaagcccttgagggattagtggagcaaaggaaatggggagacgttgagtatagacaactactaagtaattccaaaaggtattataaaactggaaagcattagaagaagaaatattgaaaaacagcgtgagcatacaatataaaagttgcttatgtgctgaaatatactgtcaactcaggttgagggatatgaagagagcagatgcgatatgagccttgacacaaagtcctgcaaacctttaaaatgaaaatcctttgaatgcctgaccttcaggtgttatattatcaaaggacagaagcgtttatgcccttttaaaaaggaaaatgtattagaggattatccaaagacttggccacatacaattcttttctggaaaaaactaagttttatgttgaaaataagtaatcaggtaatatccctgtgtccaaagagacagaaaaagcacaataaacttaacatttctaggacagtagaaaaaaagccattttcttgtggaactttgggtttgtttcctttcataaaaagggaaaaaggtgaaatttgatcttcaagaagtccaggaaagcttttagagctgagaaaagacagagttggggttggtgagggaagtagactctgggtgaaaacggataattaagctttacaaaaggtcaagcattgcaaaagacagcgagaaagatgcattctatgtgttgaatgtatcaaatgtagttgagaagatgtaaatcttcgcattggtgaatatttcagtattaaaaaagacatattaaagaatagctattcttacaaaaggaataaacttttttctttgaagcttgacacaacatatacaaataaaagcatgaaaaatatgctttgaagtgtgctaacacatcaagattgtactgagcaaagcaccttttctctgtttaggaacaatctcactaattccacaacacaatatgttaattaaaggatcccaggtagcaatcatggaatatttcttctcatgacagatgaagaatacaaatattctgaagactgaaattgtataaacaaaatgaagagacattttgtccgttttctggcagtgcaaagttaaagtgaatgcagatgaatgtgctggcaataaaatgacactattaaccatctgaagatcgggctcattacctaagaaggcaaagcatcaatttgtggcattacaacattctatttgtgctgctcaatgtgcgtctggatgtttttatatactctctactaatttgtgtgcagagtgagctcttctgcatcagcctctctatagaagcttaattttgtattgtttctcttatattattttctctaatgagaatgatattctgtattagaaataaacacttcatttattcttcaaataattctacgttcagtttctcttgttttgcattatcaagtggtgtgtacaggattacagatatatcttaaaattgaggtgctctgattaaaaatatacatttgaatgacatgtgaggaaaatattcattcactcagtcactcactcattcattcttaaaagaatgtctatgtattgggttaagcatcatgggaaattcaaggatgttgcactgtctctgccctcaggatgtttatagcatagaagtggctgaatgttattagtaccttgagataggaacaaggacagggccataaaatctcagaggaaagggaaggtcagtgtattttctcataccacaagtattacttgggtacctactatgtgacaggtgctattctagaggctggatatatagaaaagagaataagacagtcaaggtccctgaccttatggaccttgcttcctgagggtgagatggaaaataatgaagaaaaaaagcaaataaataatataacttcagatcacactaagtggcatgaagaaaaataaagcagagcaatagcaagaacagtgatggtaagggaaggatgtgaattttagctcatgaaggcccctgtgaagatgtcacattcgaatagagatttgacaatgtataggagcaagtgtatgaagttctgaaggaagggctttctaggtagtgggacctttgtaggacaggataaagactttattctaagtgggaaggaaattcactggagaattgaagcagggtatagcatgacctgatttatattttagaaggatcattccagatactgtatagaaattcaattatagaggggtaagaaggtaacctggacagaggttaagcatctgtgaatagtccaggatagaggagaacaatgagaacttgattcatgtagtctaaccaaggatgacagactggaatgcactgtggtagtccatctagatagaggtggttggtgaggactaggttgataattacttagatggtaaggagcggttccattttgaaggaagttgcacaaaggaagtgatatgatatgataatatctgagttgaactttaaatgaatggcagcatgtgacaaagcaagtagtcattcatggatttgttgagtgcttatctatttttatgaaccaggcactgtgctaggtgctatagatacagcagtatggaagccattgctgaaagtgagaacaacaaaacttgctgagaaggtaatattttaagtaaacatacacaagcagagaggtgaacaatatgctcataggaattacttcctgaattggttctaaggatgttttattcttttccatttagtgtagaaaattatgtgattaaactcctttgtatatttggctcagtgaatttgcaaaaggagtaagtgtctatcagtagaaattcaattcactgtcagttgggaaatttcatcagacaatttccttagaaatagtggctaatatttacttttcccacttagggagggagaaagtatagcctctctagaaagaataggaggataggagagtacaaaacctaggacaatctcaaatatccaggtgtatctattacagttcatctgccacctgcctccaatctgccccacagtctttttgcaaacagatgacccaacttcaactttccctccttctaatcccacttgtacactgcctctagaattaactggcctaaagtagtccagtcatgtccattccccagtgcctacagaataaatttcaaattcctcagcctgacacacactgacccaacctactttttctgctttatctctgactacacacttctcaattgttttaatcaccttgaattttcttcctctttttaaaattattttttgaattgcatgaatatgttatgaaatacacataacataaaacttaccatcatcgccatttttaggtgtatatttcagtggcatgaagtacatttgcattgttgtacaaatcccattggattttaaatgtctatttccctcatacttccagcaatttgttgcctgaaccaaatttgtttttatatggttcctggggcctcctgaaatgccttttcccatccaagtactaaccagacccgaacttgcttagcttccgagatcagacgagatcgggcacgttcaggttggtatggccatagatctgaaatgcattttcctttccttatcaattaaaatcccacatatctgaaagattcatgctcagattttgcctcttcctttaggctactttgacaccttatctggaaacaggaggtcaactctgttgctaggtaacacactgcttacagtaaaaatgatgcctggttggtaaattgcatctggactaggagggcctatacatgaactataaatacatgatggggatgtgatactttggacttccctgagtaatgactcgtgtaattaggtcccttgtagggaccatggaggataagtctatggagttgttgcaggagatatcgtctcttatggggcaggaggcttttaagccagggccattcctgcacccacccaatatgaatctagtcttcttgaacctgagctgccacctggggggccagaactgatatttgtactgatattaggactctcactgaagagaaaatctgaagcttccctggtggccagcagtgttttctgtatcacatttttctaggtaaatctcaagctaagggttcatgcctgtaatcccagaagtctggaaggccgaggtgggtggatcacctgaagtcaggagttcaagaccagcctggccaacatggcaaaatcccatctctactaaaaatacatacacacacaaaaattagccaggcatggtggtgtgtacccataaccccagctactcaggaagatgaagcaggagaattgcttgaacccaggaggtggaagttgcagtgagcctagatcataccattgcactccagactgggtgacagagagagaccttgtctcaaaacaaaaaaacaataaaacctcaagccaagtgtggcccatagtagtctcataagtctgaatgtgcagttggacctaagaagatctgctcttgaggttgcatcaatatgtagaactactgtactaaatacaaatactccttgcatgcctggactcaaaatcactgggaaccgtacacaggactagggcaataaaagtattgctcacctttggaaggagctggattgcctgtagaattctttgtctgtgcccagaattaaggattccaatttccaacaaatcctgatcttccataacattgcttccctgaaacaaaacagaaatgttacaagttaaatcaagcatttatactgtggataaataacaaggatttatttaatacagagaaaaccagtgagtgacctgatttttatgaacaaagacatagagtcattcttccgtgagggtgagggcagagtcggtcaccttgttactgatgtgaagtctaggagaaagctcccctcccctcacaaatatctatcgtggcttatatccacatggggttatctgcactggagattcattcgtgtgacttaaaactttgtttctgcacattgtgcacatgtaccctaaaacttaaagtataataataataaaataaaaataaataaataaaaaaagatccaaaaaaaaaaactttgtttctgtaaaaatgtgaatgcttctagtaagagttgccatttaagattatcagtgacttacacattgatatgaatgaatcatttttccccccttgatgacagattttgtgcggaaggctgatagaaaaattgacatatattaggcaggttaaaagtgagagttaatacttaatttcaaaatattgagtcacaatagcaaacacatagaatcaacctaaatgcccatcagtgatagcctagataaagaaaatgtggtacatatacaccatggaatactgtgcagccatagaaaagaatgagatcatgtcatttgcagggacatggatggagctggaggtcattatccttagcaaactaatgcaggaacagaaaaccaaacaccacatgttctcgcttataagtaggagctaaatgatgagaacacacggacgtagaggggaataatacacgctggcgcctgttggagggtggaggatggaggagggagaggatcaggaaaaataactcatcagtactaggcttaacacctgggtgatgaaataatctgtacaacaaagccccatgacacaagtttacctacgtaacaaactgcatgtgtactcttgaacataaaataaaagttaaaaaaattattgaatgccagacaccagatcacgatatgaagattgaatgatgaatatgatgcagggccctacccacaactgcctttattccttccagtcccgtgatggaaagggactgttcaaaggcagttaggtaggatgctgagactgtgctatgatggtgacacttgcttaggagtccagagggaatccagggtattttttcagagaaaaggacatctaatcagatataggaaaaatgggtggttaaggcatagcacctaaaagaggaaggacaatggggaaattatgtgcaaagacctgtgagtaagaaggaatgtagtatacttggaagcatcatgttctgggataatatggagagaggagcaaacggtaaggctgaatgagtaagcagagggcagaccatacagatattgcatgccatgctgagggcttcagactttatcctgaccataatgggtagccatggacagcttttaagaaagagagttacatgctgagattccaaatttagaaacattattttgatttctggggctgggcctcagtttccctacctataaaatgataaagttgagcccacaatgtccaaggaccagttcagtcctaaaattctgatttcaatggttattttaaacctgtgattaatatttgaatgcagaagtttacatattgctcattttatccctagattttaatctttcacggtttgtaagacagagtttctctttaaattgaggcgtctatagaggttcaagaattcagatcactattttttttgacaaatcaaactctgtcctacttatgtgtaacacaaaaacgcaagaatagaaatgacagaatatccatttatttagtgatgagtaccattagacactcaaagcaaaggagaatgaatttgaaagggtgattctggggcatggagaccactgtggttgttttctagaggcgctgtgggcatagactaacgtagtagtcacaggagcaaaaagaagcaggtggatttgcaaactatcaggaagtttgacgtggagattgaacatgtggaatgatgcagaaatgtggaatacacaaaaattcaaggcttgggcagtgagtggaacttgatgccttttcctgccataataaaggaggaagaacagccctggtggggcgcaaagtgagactaacatctttccctggacagggacagaatagatgcatgtaaacaacttaataatatcagactatgctataaatggataactggctgtgcttagaaggattaaagccactggaatggcacaacagctagggatttaaaacgggcattcactggacaaaagcattccacctactcatagtgtcattcttatgcttaagcaacaccagccatctcggaggaagcagaatgatccaggtattcagcagcatgataatgaaaagcctaatgaaaaacaaataaagccagtcttggcaacatgccacaggaaatattgctctcaagaaattactcagtgcacacaacagagcatggctgagaatacaaatgacttcatttagagaaagcgttattatttccagaaatggactagtatggcatgagcgagatatgtgataccattctgacttttactctttgaggagttacctggcccttaagaaaaaatctttcgtcatctttgtgctagaacattaccaggttttccaggtcctaacttaccaacccacaacttcagcccatgtagaatagaggacctggtttttttgcagaaacagaaagcatacgaatatcccatagtgtgcatagctactatctctaggtaatcctgacaactggatttcagtgtttgaatactgaaatgttttggtaaattaaatcctaaagatcactgttcttcctctacacctccaatatgctattttctgtatctcagtaagagaggagtccttttgaagaattatagggaagttagatatttttaaagaaggtgttgagtacataagaacatctttttgagccaaatttcctagcatataggataattgccaaacatttttgaaaaatgaaccaaaattatgggaagcacaagaaaaatagtgaaaatgtgtcaaaggggaaatggcactaattgggaaatggaaaggaaaggatttactgtccccagtgaggcatgctgttagaaattttctattttatctttttctataatacatagggatgccaaaaatatcctagtacatcattcagccagccttttgtccaaacactaggggacttggagtctgcagaactgggtttggatcatggcggggcaaacttggctaagtcatacattctttgtaggcttcctggtcctcacccaccaaatgaagcagtttaatgaatatgtattcagtttcaaaatgctatgatttcagccatgtttgatttttggttggtatcattatatataaatatagattgtatattttgaaattatgtttcagtgtttcagaatttgtaacctaaaattagctttaagaagtgattaaagagaaattcaagaatatatatttttttttgacaaatcaatcttggtatgatggacttataaaatttcttattaaaggaaattataaggtaacttatttttgtagtagtacggattcttatagcttttcagggaaaaacaaaatgtttcaaaccttataactatctaaccatttctttggcacctgggtgacagttgtgccatcaaagacaataaacattcccattcttcctagggagctggaattaattctcactttatcacttgcctttactaaatgctagcaaatctcagtttaacttctgttttttttttttttttttttttttgagatggagtttcactgttgttgcccaggctggagtgcaatggcacgatcctggctcactgcaacctctgtctcctgtgttccagtgattctcatgcctcagcctcccaagtagctgggattacaggtgcccgtcaccatgcctggctaacagggtttcatcatgttggccagggtggtctcgaactcctgacctcaggtgatccatctgcctcggcctcccaaagtgctgggattacaggcgtgagcaaccgctcatttttctcaataaaaactgaacacaactctagctttcttcctcctccatcatttttttttttcacataacttttaggtcaatgatttgggggcagagctccgtcatgtccatcttctgtttagtcatctactacactgcactctcaatctcctttcctacccagtacactccagtcccatgttttcatctcccattttcctcctcaacccaccagaataagctgttcccccccatcaactccatagaacttctctgtcaaatgttaagaatgacccctcaattgccaaatatagttgattcttttaaatcttgatttcaagaatttacttgccatatgtaggtgatggccaccatattggacaacaaagatacagaacatcgccatcattgtagcaagttccattagacagtgctactctacagttagagacattgaaactttagtcaaatcacaaaaatggggcagtagcagggaatcaaatcagggactcaaaaatactcatgagtttttctcaggatgtagttattcatgtgcctcttagtcaaagttcatgaacattaagtttaggatctttagcaaattctcttttaattcttcagtcaccaaaagaaattagaaggttgttctactttcagcaacatttctttatggtggggctataaatctatgctatgaaaatgacaagtccaatcactaaattatttttgactttcttagcatccaccaatcacactgcataaggtgtttaaataacaataatcaataaataaagttgtttagttaatgactttctagaatgatcaaagacccaaatgcagtatttttagaatagctgttctttgcctgtcaagaaatgtctaatgcagggtgtctttattgatctcttaaatcatggaatggaaaaagtcacctaatgttttatgcactaatagctgaaagtggaagtttctttgaccacggggagaatatcttaggtactgaacttcttcagctgtgataaactgttaggatgcccaaatagaatgaaaagcagtgttttgtatttaattattcattagaagtaaaacagctatttaccaaaaacatctcaaaaatatctgtactgatggctctgtctctccaaactctgcatttaaaatttcttgtagttttttaaacttaatacgatatcttattcatttagcaagctttccttcatattatatattgtagaaaatgttaggaaaatatatttaaggaccacagggaactggcttattcttaatataaacttgagttggataatgttatttattctcttccttcatccagtccaagactaaaaaaatcaagatgatactgttgattggggaaacttgtttttgctctataattagctaaattagattcttctccacaatttatgtgaccttaaatatttaaaatagaatcactgtataatagaatgacagcaagatcttacaaacttacacatagaaaaacatgtactttagtttgcttttaatatttagccttttataacataaatagcatggtagcatgaaactgtacataattttcttggaataacaatgctacctctctgcttctataaaagctttgagtcaatttgatatcaatttacaagtaaacccaatgcatgtcttctctgcatgattatgataatggttattgtgctaaataccagatttattattcctctgtcagtgttggaacaaagctttatttagcttatcatatagaaacacgggtgactataactgatcagataatggatgatgtgcttcttccaactttaacttcctctctcacattaatgaaatggcagtggaagaaaattctatagtacactaaaaaatccctctaccctaatcctccatttaaacatattctgtctaccgcaataaaatttcttgcatacaacttaagtaaattttcatgtttttagcttatgaagaaagctttctggattcttcagactatgtggactattgattcaaaaaatattacatcactgaccaataagacatcatcttatatgtgcaagctgtgtattttaataaattatatcttaaggttaagatatagtttagcattatatatttaacagctaccatgattacaatgaattttctgtcaccgattttttcctctttatttttgaaacccaattcccctttgaaacatctgttgtcaagctacagagaaagagaaggaatttaagtaaccaggtatttatttgttaaagtatcgagcaggatttggtgatatcataaattataaatgtaattcacttgagatgtgttcatgtaggttttagaattatgtgtatttgtaaaagagtgcaaaataatttatacagtaatttgtactgcctttggtcaaaaattttatagctatgagagaaggagcctattcttcatttttaaggatgctaacccagagctccttcaagtaagaagaaaagttgatgtgaacaaaacttttttgtatgctcttacttctctccagatgcatatatctgtataaatataaagctgatgaatacctactgtcttccttcaactttcacactgatagcagttggtgttcattagtgtaaagtaaatagcacacttactgtgtcaggcactgttctaaataccttccatatattactttatttaattctcacaataactcctatgaggtaggtagcttgttcccatagctgataggagactttctcaagacttaccctatactacctctagcaggaatcatgcaggagataaaaggttgagttaaaaaaacatggttagatccacaccatttatatttttacttcagagtcatctgaaattcacatttgaaagcgagtgttccaatgcatttatgtttgatttcacagtaccgaagcaacaatgaaccctctctatggaagagaacttggagagctgtctggcctaatcttccctgctttgctccagtcctttctgttcactgaatcctggaatcaggcttggcagggacctggggggtttctagtttctagtctaaacgttccctaactacccacaaagcttcaacttctcttttgaagtgtggtgtctcactgggttgacaccatccccagagaggtagggaggatattaaatgctttaaatggtctttcccagcagctgagtctgagcagggggtgcggctggggttggggtggcacctctgtcctactcttttagctcccactgtggtacagaccaagtgttgcaggagagctatctgaagaagaacgtgccagaagcggagatgaaaggaaaacagttagcagctgtcctgtgtccttttgtaatcacaagctgtgaagctgaaaaaaaaaaaaaaaaaaaacttccttgggtaggctgtacataatcttggcagatatctgagtgttgttcttctgtctaatatgctgaacgtttcccagtgcctcacaagagaaaagtgagacagggttaggtgagtttggacaccttgctccgaacaggcagggaacatggcgcccttgtacgttcatcaagctcttgcaaatgccctgtcactgtagatgctgatgcagagctccaaaaggaagggctcctctgcaggagaagcaaaaagaatttgctcctgggtattcccaacacagccacatataatgacgcagaaagaagtacctaaaaagattaccagccattacattcactgtgtagcaggtacttcacccaccttatttataaaccttacagcactcttgtaacataggtggtattattttcatcttatagaggaggaaactgagtctcagagatgtgacactatggagtcaagttcacaagataagtataggatggatctgggatctgtgttttatttggtcagactctgatgctgatgcttccttcactacataaaaagaaccaaatgtttagtaggggacattttctggatggagattccggtccatagatatgtaacgttaccaagaagttactcccatgaccctattttcacacacacaagcttacatctatatttacagaccatagggagtgactgccagagtttctccaacacattgaatttcacataaattatttatcttctgaaaggtcaactggttagttctccttctaaactaccttagtgtattccagaaccaaacatgttaatcaaagtgacccaaggtgtttgtggctaaagcactaactaacttgccatgtttcctgctgtgaggcaggaagtatcagcatggcattaggttgttgtgagagattcagctcttctgcagtgccttgtcaaacgacctgactggtcaactgggaaaatgaagttctcagggccaacatcgtatttgggtgtttttcttttaggtctgtatcaaagccagatttaagaaggagggtgtctacaaatgaacgaaagcagaggatgtctggggacaagctaaggacatttgtgtcccacactgcatgtattctgaatccagagaaaagagagtgagttgcagtctcctgagaaggctatccaggctaaggagcctgtgatggtgaaggtggataatttagccctctgagaagtgtagacctgtcaaaaaggagattcgttaattcttcaaagatatggttgtcttcaaagaacagacatccccagatttaaggatgatggggtctcttgacactgagaactacattcagaaatagccaaacaagaggaaaggagcaaagaggaagagaaagggagggaggaaatgagaggaagtgtttattcttaagggtgaaggtagtggtgaagggagtagaatttcctgataaaatacagaaattcaaatttaagtggcatcatgtatttttattcacttaatctggctgccttagacaggaggtcactgaaatctggaaatgagctggcagagtccagtccagagctaccactgaggcaggcattgtcattcattcatgtagtcagcatttgtttgttcaataaatattttttgagcatttattatgtgccaggcactgggctgtggttgtgagatacaatgagatcaggacagacaaggtccctctacctttagaatttacagtctagtggagaaaaagggaaacagtggaataaaaaaatagataaataattatttagcaaagttttactatataccaagtatttactgtattagtagggactattaagcactttgtcttgtttgttgttcatgataaattctgatgttagtatatacaattattatccttatttacagataatagactaagaattgaaggcacagaaaagctgataattagtctaaggtcacacaggtagtaaaactgacataaagggaatcaatggagttctaaaataaaaaataaacaaataaataacaacggagatctatgttagaaagactggtgaggaaagtctctctgagaaagtgacatgtaattaagacctgaggggattagaaggagcagcctaactgtgagaagagctgttacaaggacattccaggcagaaataacagcaggtgcaaaggcactgaggtgaggaaaaaggtgaggcatgttttaggaacaaacagaagcctactaagaataaaatttagtgactgagggggacgaagacctgggaaagaaacgcaggaaataagacaatacagagacttgcagactctgataaggactttgattgtattccaagtgcaatgggaaacattgaaggaaatatactaatttgcatcttcaaatatactctggattcggtgtggagaatggatggagaaattgggaggtatggaagttgagctcgacaatcaaaattgaaataacagcctagaaacataaataatctaaaggaaatgtgatgaaatatgaccttttgggagactatgggaatgggtctcactggggggggggtcaagtctccaagccaaatgcatcttttatttgaatcaaagagaaaagccatatgacaaggatgaaatcagaatagtctttgataaaggttctatgtggatacaactatgaataaagatttagcagtacctacgaaaatgaaaatgttcagactccatggacccagcaattctgtttcttggtcgtggcagacattgctgggaggctgagtcctttccctctcactacctcccactgcagaggctggataagctaaagttctcagcttccctttaaagcaatggttgaacatgtgacagaagttgtcattggggaacttctggaaaagcttttgctttcctaatgaaaagggaaaaattcacctgctacccttctgtgcccataagaaaggactctcctcaggatgagtggctaaacagttcagagaaggtgacagcgatgggcccacagtccttggacctccaatgatagatatctccattggatacctggaggcaggcaaggataggccatggaagggttagttctgcataaaaaacgttatttaaagctctctccatcttttgcatctaagttgctctgactagtgtttatctgtcagtgaaaataatgatggggatgtgtactgtggcatgtaattaatagaggttataatggaggcaacaggatatttactatttattttaggcagacaggggtatgataacataaagaatagcagagaagggatactaggaagaatgaaagttatcagatccaagttggggtgtgtgtgtttgtgtgtcaattatagcattgcctcttctcattttgacttaacgttgtgaatttctcataaaaagatgacttgaaggaatttctttactctggattttggtttctattaaaaactaaaacggatgcaaaattgccaaagtgctcatgggactaacaggttctaaatctgggagtgggtttcagcttataattgaagatgacaggtgtccagagattgtatgaagttatggttctaaaggaagtacagttttacataaacctggtattctacaggaaaaaatgttactcttgaaatccaaacacattataatcataacagggcagaaacaataagaacatttaggggtatgttaggttgaccttagtgtgtagctcttccaggaactcttgagaagtcagagtttttatttaggtcctttgtaatctggaatgcctttggtgggcagtgaatggcgattattgaaagagttgactgatagaatattcctgacttttccccacatttatttttagttttggttttggtcttgaagacatttttcttaagatgtcttcaggaaaaaaaaaaatttttccacattgaaaactttgttttggctttttcgagtttaaaattcggtgatgggaaaacttgctcacatcacaacaatgggattaagtgtgaggagatgatcgctgtgggcagacaggcaggaggctaaccccacgaagggctaaactaaaagctgagtaagagctccactaagaagagctctttgaactgttctgggactggctagggccactaattgtccttgggttgtatatgaagggaaaatttgtatcagggacacaaatatccttgtcctttgtatagcatctatatcatgaaggatattctcattttttaactccattttcttcactgaataatattactcaacctgaaagaaatacaggggaaagaaacggagggacatgcattctcacagtgaatgtaattaaatgtcctcctgtctagtttttcaagttaaaggttctgagttttgtttccagaatattcaactggtactaaaagcatcatgaagtccctcatatttaattaaatggtgcattattaaaagggggcacactctatctaggttaaagaggtgataaacagctatagaatttcatgtttctttctacttggtattatatgtcttgtttcctttactggacagcaaacttcttgggagaaaggatcatgcctgaagcatctttgcatctcccctaacatctgtttgctaagtgttgaataaaataaaagcttgaaagaatgaatctgtaagtaaaaacatgagttttttagatttattaaaaaacatttagtctaaagatcactaagtaagtttataggaaaagcactgaaattttgagctggaaattctaatatgcaggatgcctgatgtgtttttcccccctaattgaaagaaagataaagatggaattgctggtacaccataacaccaaaatgttcttaatttttttttcagttttgcaaattctcatgatttgattttcatccaggactgtcagttgagacatctgataatctaaaagcattcagagaattaggatcccatatggctcgaaaatatttcctatccggcaggaaaaagagaacataccatgaaaataatactggtatatccttcaatttatgtgtacaaggagcataaataaatttaaatcattattcaaagtataataattataatgatcataaggttgattataacaaccaaaataaaaagaatatacagttcttcataatcatgtgacattataaaaaatcagaagtatacttcaaatcaatgatagtaatagagttgtgtttgtctaacagaagcaacagtcattagaaatgagcacgggattaggagtcctggcttatcactaattaactgtataaatctgaaaaggtaatttaactcccttaggtcttaattttctcaactgagccatgaaagggctagaccagatgttcccttttaacacggcatctgttctggaggttctaacaaggagtacatctactcatacactcctattgcctgaagaataattaattcttcttgctttgggggaaatgtcattttcttcagataagtgttcagtattgagaggtgcacttacataatggtgagggagcaaggagacctgggcttagtcatctaatttcaccaacaaaattattactaacaataacaataacggctattcattgagagttaactgcaggccagacactgtgcttttatcctctgaacaattctataaaatagatatcgctattatcatccccattttacagatgagaaaatggaagcataaagattactaggaacttggctgagatcacacagtaagtggcagagctgctttggaaatgaagatgggtgttggaatcaaattcccctcaccccactggcttcccatagctttgacaagtgtcttctgcatggaattgcctcagagatctgatggatggagtctttctctgccagcccagtcgtctccatgaacctcctttcctacaatttctacccagggattgaggattattaataaaaagaaaaggaattgagtgctcctgggttcaccttacagctctgcactttaatagcagtgtgactcaggatcagcaatcctctttctttgtccgtacaatggggataacactaatgcttatcttttaaggatatggtgacataatgtttatgaagttgctttataaactctaaagtaaaattgctaaaaataaagcatgcctgctaggaactactttttttttttttttttttttttttttttttttttttttttagaacatagcactgtaaatcttctagtttcatgttgtttttgctggaaatagtctattctgaaagaggcagcatgtgtgatggcagaaaaattcagggttcccccccccacccccagctctgccatttacttagctttgtggccttgggaaagtcacttgatctggcatcccacagggtcccatactctacaggccctgcatttggggtttaatttctgtggttgctgttttgaagttcttcctaatttttttctttgagtttgtgtgttataagtgaagtctgaagggacaacggagcatgcgctgggcttggcaccttagatcatgggaggtcttgcttcctgctgcatctccaggatgggttctgccagagaccctcttcattggtctctctatctttagtcctgcccaacctccctttctctgttgagtcctaaaattgctgccatccttcactcctagcaggagtctgggtgccggcagagggagggcttgggtgggtcactcaaacccatggcaccttggggccgagcatggcatcgcccatccctgccctaacaggtagcagcattccaaatcaaatgggtgaccagccagaagctatcccaatccagatatcaagcatgtcctgatgaagagatttaaaaatcctttgcggggtgggggtcccctgtctgctatggatggaggtaatgtggcactggataaaagagatgcctggttagattttctgggaccctgctctatccaggacactgtggtagtcaggagagtgttgggggcctggcagtggggcacctgtgccctgcataggaggcacggtccagggtgcttgcatggggctgcactctcactacaagtgtcttgtgccttggaatgctcctttggctagctccatgcctggagcattctccctccttctaaccgtcctgggtttggcctgtatttgtcttttttgaccagatcaaggcatcctttggataaaaacacaaaatataaactggggaatttggtattccttcataggagttaaatgctttaatattttcatctaaaagtaacattgcacaatataaaaatgaatgacaaaattcatgctaataacataaaattttaatgtttctttacacagaacattaaatagtaaacaaaaaacaccatgacaagtctaaagagagaccacaaaaggaaggaaaaaggtttgtacgtatttttaatggcactctttcccctgccttttgaatagggggccccacattttcattttggactgagctccacagattatgtagctggctgcgctcccaggatgtaaggtttgcataatcacctggtccttgcttcacttcacaggtatatttgcagcagctctgcttgtagttggtaagctcagttaagcaacatagttggactgacttaagaatagcttaccatccaatgatctgtggctttatctttacctttccaagtgggtagaaaaggagtaatgggagccattcccttggaaactactgaggtcatttaaccctaacaaggatgatgcttcactagatgttaattagagatcatttccatttttagttttagttctagaggttgccttaaaaattatgagggcaacaggaaacactgaacttgcctagacttctggggcttctttattcattgacttattcattcacccattcaatcattccctccttcactcacactatcatttcacaacatttactgaagtgctatcatgctgcccacactttaagtatggagaattcaaaagtgattgaggcagtctctctcctaaagaagctcaaagtcactgggggaggggtaaggtggaggtgggatcagaaggcatataaagagattatttttattattgttttgagacagagtcttgctatgtcacccaggctggagtgcagtggcatgatcttggctcattgcaacctccaccctccaggttccagtgattctcctgcttcagcctcctgaatagctgggattacaggcacatgccatcacgcccagctaagttttgtatttttagtaaagattgggttttgccatgttggccacgctggtctcaaactcctgacctcaaatgatccacccgcctcagactcctaaagtgctgggattacaggcgtcagccactgtgcctggtcaaagagactatttttttgatgcagcacatacaatgattatggctgtacagagaaaagattcctgaagtacacagctttggatcaggaaagacattttgggaagcggaacatctctgctacctgctaaatgatgaggaaaagttaaccagaatacaggcaatgcttgaagcaagagagagaaggcactgcgtggatcggttgcagcatgaacaagggcaatgagaaaagaaacggtatagtgagagtgaaaaccagaaagcagtttacagttaaccaggtggaagaaacagggagggagagaccaggtagccagccttgtaagcgatgatgtgaagtgggcttcatcctgtggttctgggcagttggcaagttgttttatgcctggaagggagatggctggatttacaatgtagagagcaaactccagtggctatctgaagtgtggatttgaagggctaaaactggaggttggaagcccatttaaagagctcttgcagccataatacaagagacaatgaagatctggactaggacagcagcagcaggaatggtgatgtattaaagaaatactatagagccaaaactgactgaacttgattattgattaaatataggtattggtagaagacaagtgttaagaataactgtcagcgctcttgtttgggtaactgatggttaaggagtcaggtgagaaatagactttcagaggaggtagagggtttggaggtacagtgttttgttcttgtttttgagacagagtctcactctattacccaggctggagtgcaatggcatgatctcggctcactgcaacctccacctcccgggttcaagcaattattgtgcctcagcctactgaatagctgggattatggatgtgagccaccatgcccagctaatttttgtatttttagtaaagacagggtttcaccatgttgtccaggctggtcttgaactcctgatctcaggtgatccacccacctcagcctcccaaggtgctgggattacaggtatgagcccctgcgctcagccttgaggggctgtgttctgtttgggacatgcttaggggcctgtggaactggaaggaggggatgttagcagacagtgagaggaggctgaagtttggggagaggttcaggctaatgttgtagatttggggatgatcagggctgaggtggtagctgtatgaaatggataaatgcagcactgagaagaaaggggaaatgccatgagagaaagaaggaaaagatgaagttaatgaggaaaagagggagagtgtgtcgtgtcagatgccaagagggtaacgagtttcatgaataaggatatgaaccaactgttaaatatggcagagaagtcttaatggaagtggaaaaggccctttggtttggtaaaatacagcagctcatgaggaccccaggaggagttttccattatgggtacaaaagccagattagaggattgtgagacaaaaggggtggagacaatgaatgtagacgattgttttgagaaatctgaatgagtaagggaggagaaaatgtgcagcacagctggagaaggaacaggatcacaggaagttgctttattttcttcttcttcttcttcttctttttttcactcgtaagaataggaggtgactgggtgcactgggtcatgcccgtaatcccagctttttgggaggctaagataggcagattgcttgagcccatgagttcgagaacagcctaggcaacataggaaaaccccatctctacaaaaaataaaaaagttagctgggcatggtggcatgcacctgtagtcccggctactccgggggctgatgtgggaacatcatttgatcctgggaggcagaggttgcagtaaactgtgatcataccactgcactccaggttgggtgacagagtaagatcctgtctcaaaaaataaaaaactaaaaagaataggagactcttagctgggcatggtggttcacactgtagtggtggccacctgggaggctgagatgggagggaaaattttttgaggtcaggaggttgaagctgcagtgagctatgatcacatcactgcaccccaacctaggcgaccgatagatatgtgttttgaaaacataacgctcagagcaggttgaaaccctgtctcttaaaacaataattgaaaaaaaaaaggagacacttaagcaagtttgcaggcagcaggtaaagcactagtggagagggaagttggatccacaggagagggaaaggaaaactgctggaggtaggaggggtaggcctggggtgagataaagggcctggaagagggaagcaaggatgggtgaggtgtagaatccttactcctgaagcccttcactgctgatacttctgctatccttggcatgtgacaattcctcaagctgaggtcaatgccactgtgtcaattgcatagcaattctctttcttggggattcctataaaaactccctcataacaattccccaagtctctagtcttaccttgacgcccctcagtcttacacaattccttgctattttgactagtttgaggttacccatcatgaactccttcgacatctctcctatcttgatttatatactcttcttggtctcattttttcctgcaatattaaaaattctactgatctttcaaggtccaactcaattgatatcccttatctatgtctcactttcatcttacatatacatttttaaattacttgatgtcttttatgttatcttataagctaatttaaatacttcttaaaacaaggaagggattcaatcaacctatcaatcgtcatgataccctttcctatctcatcttcttttcatcttcttcaactttttgactcatttttatatcattcctctatgaaactattaaaccccttaagggcaagtaaatgttttttgcacctgctctagtatgacaatacattatacataatacctacctactacaattaataaattgtaagctcctggaggacaagaatttaggagttagctagctagatagagatgaatacacatgcagagatatatttacattctctcaagtataccaatttaatctaatacttactatatacttgctagcaattagagatatataaagataaataaaacaaaacacagtctctgtcttccaagggtgccaatccagtgtggcaatcagagaatgagagggcttgaatgacatgctgataaaattggactgtattctgctaggtttcttgcagaacttagggcagaggatattaatagatatgtgttttgaaaagataatgctcagagaaggatgaaggatgaatttgaaaagaatgagattgagggtaggcagatctatgagggggcttttgcaatagtgtagatgacagataataaagatcaagtgagggcaagttggttacagatgagatattgagtgtatatgcgtgtatgtgtatgttgggggagtgaggttgtggtgcacaagaataagtgtccagaagttatttgctaatcttactttttaaaagacattaaatggtaaatagtagtaataactatagcttattacatatcgtgtaacacattcctctagactggccttaggcaatattgagatctgttccatttcaccacttaggatcctctaggcccgattttggcactttattctatatgatcggctatttgttcttctcttattacttcaggtctcaagttttgatcatcctatgagcccatatatccttcagagcaagacaatgtgaataggcatcgttgcacttggtagagggttaggcaaatagtggatgccaaataaatccttgtggaattgaatggtattacctggagttccctgaaggttgtacatcctcttactccttggcctttggaacgtccttctctatacctggaattcttcctctctctctttacctcctctgactactgtctctttacctcactttgaccttcctagttctgtttatcacttcctctaagagttgttgcttgatgcccctgcactgggttagcagattttgctaagtggtccacagaatcacctacttatgtgtttctctgccagctctataaagacagaccagactaccttgcggtaatttgttcagtattttatccccaggttgagcacagcacctggcatacagtagacattcagtaaatatttgttaaatgaacatggttttgtggggttttatttgtaaatctgaacattttgaaatttgaatcttcaaatagctggacataaagtgctagatccatccagacgaaagaaataatgggagaccatctagaaaagtattttgttctttatgctattaaattcagtagaaattagttattatattttttgaggactgttatgcaattaacactctggacaacatgaagacagttcagatttcacctttctatcctgccccccaaggacatgcaaaatatctgcttgggtacccgttttttcatgtgtacacactagcatcttcagttgataagttcctgtggggcaggaacagtaaacttctcagaattagaaagcaaaagtgacagcaaaaacacgacaacatcagaaagccagattctatgtcagaaagtcttaggagttgtagctttagtgttctgcagacaacccaatgtcacaggaaatactaattcccttgctctggggcatttattaaaaacaaaattttttgggaggccgaggcgggcggatcacaaggtcaggagattgagaccatcctggctaatatggtgaaaccccatctctactaaaaaatacaaaaaattagccaggcgttgtggcgggtgcctgtagtcccagctactcggtaggctgaggcaggagaatagcgtgaactcgggaggcagggcttgcagtgagccgagatcatgccattgcactccagcctgggcaacaaagtgagactctgtctcaaaaaaaaaaaaaaaaaaaaactaaaactaaaacaaaattttacttcctactgcctggtaccatattatgcagtagagacagaggggttaaggaaatcaggcatagtccttgttctcatgtagtttgtagttaaggagtgagagaactggcagtgacctgattttgaagaggctgattcaggtcaagacccaattttgaagctggtctccaacaagaagagtggtttctaggaatatagctctgcacaagcaaatacatatcccttagacagtctgtgacatggagtgaaaaaccctccctgacagatcctttactagggatctctgcaagggctcagatctctacttcaatagaaatgctcattggtactatctgaggacgatttttccaagaggcacaaggagatcaattactactggcagcctaatttgcaagataaagaaatttcccattattctagtatcttcgcaaccacagtctacttcagcatcatcagccgacatcatggcatagtggaaaaaaatttggaatagctaaaaagtcacagattagaagttctcatagctgagatgctgctatgtgcttcttgttaaaatccagggttaggacaagggtcagaggattcttgtccttctacacttgagtggcctacagccatgtattcttctaaatcatgttttgaatttcgtcttgaaagataatgttttaagagtgctaagcttatatactcatacaacagaaataatatgtgtgataaagttgggcaagaagtgcttttaaagttgtcggtttctaaaggtgtctttttttaaatgggtacttaatagttatacctatttatgggatatatgtgatatcttgatacaagcatacaaagtgtaatgatcaaatcagtatccatcatctcaagcatttatcatttctttgtgtaaggaacactccaattctactcttttcatcattttggaatacacaagaaattgttaatcatagttgccttattgtgcttcaaaaaagttgtcttttaggttgtcttaaaatttggttacgaattgataacactagtcagaatcatgatttatattctgtagatcatttttttccatttagctttcagttataatacctcacagaataataaagcttgataggttaagtgtcttggtcctgactatcttgagaataatggttggagcaagaactatggtccagacgtctgctctagctgcaatgtttcccctccctactccattacaccacaatgatggatgaatgacggatgctgcagcagaagtaattacagtaaactcaagatataaaaacaattaatatagtgaaaatatataaattaataataaatataaaatacatgcatctttaatattaagatgtaatataatttataaattaatatagcaaatacagtaatatctaatggacagtgaccccatcaccccacttttacacgtgcctctaagagccatttcttatttttgaaggggagcagctacaccctcactctttgggttgcggtgccgtgtagaagtgatgagaatgggaaactgatacactcctgcacagagaagccaatctgaatgccagatgattaagtagaaacctccaccatgctgcctcagacttacaaatgaagtgcaaattaaaatgttagatagacatactcaacagcctgtaacatcacaaggactgtctttggggtatccatttctataaaaagaaaatctggcattcctttttggaacattaggccaaagtagaggataatgagaacagaaatgccttatgcagtcttaataatctttctactcagaggattcagtggaaactagtaactaaaaaagattagccttgcatcaagaccgagctatccagaaatcgcccggcctgggatgcagattcagtcacttaagtgagttgtaacacaggctcacttgtaggtttgccacaattttcttgcaattcagttccttcctctgtcaggctgcaataatgagatgaattcctgcaagaagtactcccagaaagacacagggaggtctgagtagataactaacacagatatctagagaacagaagtgctagacgaagagagaaataaacacacacaataattaaaacaaagatttttttaaaccatagcgacattacacttatctcaatctttaaaatccaggatatctatatctttgtgtatttctcactgaaactttccctgggcctcccaggaagaacataaagaataaagaataggttcattttcttacagattaagagatgtgaggctcaaatgaccttatcctggtaacatagctacattactgcaagagcagcatctttaatccctatgattcctactccagtcactctttaccagtgaaccatcaaagtaggtgatgatgctgaaagaggtacagaagattcagcttgtgaagataagccgaatgacagaaaatgcactttgtgcaaacctccatgcagtgatcacaatgcattttagccagtggttcagttctctctctgtccaactagactatgtaccttgaggatagaaaccatctgtccacctaatgtccccagtagtcagcacagtaactaacacatagtagtcaattaatatttgaagaacgtataaatgaatgaatgaaagcatgaatggatctggaaaagttgccatcaggaattggggccctgaagaaagaatggggttcataaataacattcagcaatcatagtcactgaattgggtactaatattagtgaaaataatagagacagtaaaaccaattataaatagataaagaaggtagtgcttgttctgttttgtttcataaaagattgacaattttatttatgaacacaggatttgagctaaaaagagaacagataagaaggtaggtgactaaagaaatggttgccgagaaaaagtatgaaacagagtttagaacagagaagaggatacagagataattgtaaaggtgtttgacagaaaaagggaaaaggagaaaagaaaaagctttcagtaggacactttatgggcataatagggttcttctttagggcatttcggaagttgagagagcaaagatgagaactcgagagacatggaatggacaaaagagaaagggaggtgagatacatggtactgatcactcacagggaatgaggaagggaagtaaatggcctcaaagaagtcatagctgtcatcgagcagcaaatgccttctgtcatgcaggtggaattaaagcttaaatgtgaactgatggtccatcttcagcttctttctcttctcgctctgatacctgccctcaaggttgctccctggctggtcagggaactcacactgagctgtagaatgttcccaggctctggacctttctgtactgttattcaaccatcagcacttgctagcttctgtcctattctctcaggatgcctgtttttattaaatgacaaaggaagttaattggttcatcaagtagagcaattcctattgtgggcttagctggctactagttaccttgcctattacatataacagcagtgaaataaacataaaggaatgaatgggtgggctttcattacgtgccaggccctgagctagatgcagcagagtatggcagaacaggacatgggctttggagacagacacacccaagacagaggtctggtccataatttcctagctataagcttgaggaagttatctcctagggttcttggattcttcatctgtaagatatgaagaataatttcttcaccctcaatttcctcctctatgaaatggagataatgttgcctacttcgcagggttcaaaatacatataagtgataataatgttatttactatttattcatttatccccactttaaaaaggaaaagctgaggcacagagaagtaaggtgtgactaaggtcacctagctgggaaattctagagctggcatttaaatctagcatttgtctttatgcacttacccaacatactatgtcatcttaaccaatacactaaagcatcattagatgtttccatctacagcctcttacagtggggaaacagtttgatattcaccaatctcatttaaccctcacagcacctctgtgcagtactaacatcttgctttaagatgaggaaaggaaagctcagagaaggtaaccgtggccaaaactcaacataggcccagagaagggaacaccagccaaaactcaaagagctaattagtgacagaacttgaaattagatgtagggtttatgaccacaaatataaatataagaaagagagccaactctgggcccagagtagatgcccacatctttactagttatctaggtggtatttctacattgcttttaaagttctctgatagcaaagctgaaacctggctaggtgttgtaagatagatgagaaactgcaagtcaaggtgtgagttcaatgagtggattttaactcctaacttcaggagtactggtcaattatcctttactgagtggtgctatcagcccacggtaaaataaattagatttttaagaaggtgcagaattgccactataaaatcagataagcctactgcagttgggaataaattctatcatagaaatacatcttgcctgatatcaaaggaagccaagaaaccatgccaagagttggatgaaaactgacattttctgctgtggagacagaagtggtagcactgattggagaattatattttgaagagttctaaaatatttatcatcattctaggtcatttattcatttacccttttaatgctcatttcttttgtgccactaggtcgagcttaaaagcaaagaatgaaaattcactgtgtttttatatattaatatgaagcaggaagtttctctattgcttggtttgaaaaataaaagcgtttctgagaaatattagaacactaaatgttctttcagaaacatggcttttgtcattaataaggatgctgggtgtatctaagcgtgttatgaatttgtacttttttttgtttgataacttcctgtaacttgaagtatttcaagaagggaaaaagctgataaaaactactaaaattgccattgcttcactgtattgattgccccattatgtttctttctagacttgactcaggcatctccttctccaggatgccttttctgctctccattctaattaagatggccttcctctgtgctccaggagcatttacacaaaccactatccatcactgcccttatcacactgcatcgaagctatctgcccgcacatctgtgccccctggaaggcaatcaggacaataaccatggcttatattccacctggtgtcctcagcacctggcatggagccagaactcagcaaatttttaccaaagaacaatgaattttaaaacctgactatagaatggcagaatgctccttctgcctccacgaaatttactttcaagttgaacaattttattaaaaattccattttctaatggtatcagagacctgcaaagctaaagaaaaagcaagtcttatttccaggtcagaacttatttcccaggtcctcactatttggcttatataatattaaaaggtatttttaagagtataatttctatttctcaggcttgaaggatacttttgttagtgtcctcatagctttctattttggctttgcatccagagaaatgaaagaggcttgactcagctgccgcttaatactgcacaagcctgagagagaagactattatataagctaatgtgtattttaaggtgtttttttttttcatagccaatacctaaatgccaccttccaacctcatgaaagtgctgaaccccagtgtgtgggaaagcgaggtcccctacacggctctgtattccttataagtataaaaaataaaagcagttgattaagggttagcaattttcttttctttctttacacgtacttgtaattcatttaatgcaggaagtgggctgagttttcttgttctttccaattcaactctcagggagctttcttgccagcctgctatggttaccatggcaacaaggcgatggtggcagtaatatgatctcatatgccttgtgtcaatagcatcagatcatcacgcttgaggataattttgacaataagcttcagatatagattcaggatatattaccatttgattgatttaccagaaatactgagcaattacagccttaaacttctaataaaagcatgttcacaaaggttagcgtttttccctagatgacatattatatggcattctgaaatttgtaaattgctttcatatatctgcttcaattctcattaggcaggacagatataatcatccccattttatagaagaggaagtaaaggcccgtgcaatgtgctgtgtaaggtggcaaaagcaactccacagtgaagctgaaacttcaacttgaggcttctggcatcagaatcacactttcctcatgcctgtgttaagaattcatgggtattatcaaaatgttcttagatgcataggttagaccctggaatgtctgaattaaaataatgtaaatgtatctgtgataaataactactagtttgagaatattagtattttatatttgggtgatgcttcatacattttatatctcccattacaccttcctttcctaaggcttttctgatactagatgcacaaatagatgcttatctctttctcccactgatcaacatcttgtcttttttgttgttgttgttattagtgacatttatttttccattgtgagttccttgaaagtagggatcatgttattcattcttggaaggtccctgatcctggcacagtatgtatggatctgttatgtatcaggtactgtacataatatgtaccaggtacataacagatacaccataaatgcttgttgcttgttaaactgaactcatctgacacccacaaaccccatgaggtaagtacagctggcattatgatccactattttaataaagtggaaatagaggtcatggatatatcatgggcaatttaattctttccactcccagccatgtgctctttccatgtcgtcctgtttgctttattctttcattgtttctctttcattcattaattcatcaaacatttattagttgctctttctatatcaagcattgctacagataatgggttacaaagataaataagacacaatcctcagcaccaaagggctcacagataatgcagataattttctgcctaggcaagtagtaaaataaaaccttatatggaacttcgagtatgcattatattatttcccaactttattggctctttaaaatgtatcttgagaatatgtttcaagtccctctttaatgcagtgttttagaactggataagccttgagccattgccaatatagggtgatactaattctgcatcttcgttttttttcttgggcataaaatcagcatttccaacatcccacagaatccctaaacttaacgtgtcctcaatgaaactcagtatctgacctgaacgaatgggaagtggcagaaagaggcagatggtcagggtgagatgccagactctgccgtttgatatgacttagggtcagttacaccatctaggggtttcttcattagtatctggcacgaaacacagtgttcaaaatacttcttaaatgtattaattaatgaatgagttgtcaaagaggatgaaaaatgatgacataaaatagggatacctgaagcagtgttagcattagcaggtactcaataaacatcttttaaagagtggactaaatatatacgattcaattccccttcctgaaacatattaaattgccaagacaaaacttctaagttatctttatgtctctttccacatcatagagtcaggtttatttcacctctgcaatgtcttggacttgtgcctttctcttcatccaatagcatgatttgatccaacccccaccctttcactagtagactctcagagaaggcccttgactgaacttcctctctttccagggtctcccattccaccttactggtgaaactcttatttttaaaggataactaggagtgtataactcttctggccagagattttgtattgatttgtatattctaattaagaaactttttagaatggtaatcaagatcctctaaaaggtgatctttagttatacctatagtcattcctttccatatactctaggttttagcttcccctacacacacttttggacttttaagctttcttcctgtattcctagttagtggagtaataacagctttgtaatacttttgcacaacactttgcaatttgtaaggaactcatatatgtttataatgaaactttgtgataacctcagagtaggtggatatgatcattttcatttcaccaattaggaaattgaaaatcagagagttaaatcatacagattctcataacctttatgagaattctattggaaaatatttgtgtctatgatgattgtttaaccatggaatacttgaatcaaactctttaaattaacaactgtgacttcaaaatgctaacgattgacatttgttcagctcgttagcccagaggctaatcatgatgcttttcttctgcatagcaaaagaaactatcaacagagtaaatagacaactacagaatggaagaaaatatttgcaaactatgcatctgacagaagtctaatatacagcatctataaagaatttaaacagggtgggcatggtggctcatgcctgtaatctgagcactttgggaggcggaggctggtgcatcacttgaggtcagaagtttgagaccagcttggccaacatattgaagccccatctctactaaaaatacaaaaattagctgggcgtggtggcatgggcctgcaatcccagctactcaggaggctgaggcagaagaattgcttgaacctgggagatggaggttgcagtgagccgagaccgtaccactgtactccagccttggtgacagagcgagactctgtctcaaaaaaaaaaagaacttaaattcacaagaaataaacaaataactccattaaaaagtggcaaaggatataaaccgatacttttctaaagaagacatacatggagccaagaatcatatgaaaaaaagctcattatcactgatcattagagaaaatgcaaatcaaaaccacaataagataccatctcacaccaatcaaaatggctattattaaaaagtaaaaaaataacagacgctggtgaggttgcagagaaaaggcagcacttacacacgatgggatcataaatttgttcaaccattgtggaaagcagtacggtaattccttaaagagctaaaagcagaactaccatttgactcagcaatcctgttactgggtatatacccagaggaatataaatcatcctcccataaagacacatgcatgcgatgtttactgcagcagtattcacaatagcaaaaacagaatcaacttaaatgcccatcaatgacagatggaatgaagaaaatgtggtaaatttacaccatggaataccatgcagccacaaaaaagaacaagatcatgtcttttgtgggaacatgatggagctggaggccattatccttagcaaactaatgcaggaacagaaaaccaaataccacatgttctcatttgtaagtgggagctaaattatgagaactcatgaacacaaagaagagaataacagatacttgggcctccttgagggtgatggttgggagaagggagaagagcagaaaaaataactattgggtactaggcttagtacctgggtgacaaaataatctgtacaacaaaccctcgtgacactagtttacctatgtaacaaacctgcatatgtaccccacaacctaaaataaaagttaaaaaaaaaatgatgttcttggctgggtgcagtggctcacacctgtaatcccagcactttgggaggctgaggtgggtggatcacttgaggtgaggagtttgagaccagcctgactaacatggtgaaactctgtctctacttaaaaaatacaaaattagccagctgtggtggcgcatgcctgtaatcccagctacttgggaggctgaggcaggagaatcacttgaacccaggaggcagaggttgcagtgagccgagattgcaccattgcactccagcctaggcaacaagagcgagactccgtctcaaaaaaaaaaaaaaaaaaaaaagatgctcttaagctggattgcctgtgtggaatcctggctctactatttcctagctgtgtggtcttggatagattacttaatctctctgtccttcaatttcctcatcattaaactggggataccaatagtttctattgtgtaggattgctgcaaggattagtgaattttatgtgcgtaaagtgctaggataatatctgacacatagcaagcactcctaaatgttgctacccttaaagacacaacctaagaacttctttggctagtccctggtctgagaaggaaaatcaattccttcctcattggtgctaccttgtttgggtcttctatactggggacactatagctgcctcagggtgttggctcaggatagattcagaatatctgaatctacttattgggagcagtcactgagtttctctaagcctcattcaccatctgaaaacacctggataataacagcattttacatcataggattgtggtgatcattttattaactagtacatataaggcatctagtgcttggcatggagtaactaatcagtaaaatttagtgactattactgttacataaatgttttgcccatgatattttgaccttcttgggttaggacctgtctttttcgttatctttatgcctatctttgttgcttcttcacagtagatttaaaaaaaataaacatttaaataaaaaagattttgcttatgagtgtcttggctatatgggctcttttttttgttccatatgaaatttaaagtagtttttttctaattctgtgaagaaagtcaatagtagcttaatggggatagcattgaatccataaattactttgagccatatagtcattttcactatattgattcttcctctccatgaacatggaatgcttttccatttgtttgtgtcctctctgatttccttgagcagtggtttgtagttctccttgaagaggtccttcacatcccttgtaacttatattcctagatattttattctgtttgtagcaattgtgaatgggagttcactcatgatttggctctctgtttgtctattattggtgtataggaatgcttgtgatatttgcacattgattttgtatcctgagactttgctgaagttgcttatcagtgtaaagagattttgggctgagatgatggggttttctaaatatataatcatgtcatctgcaaacagacagtttgacttcctctcttcctatctgaatacgctttatttctttgtcttgcctgattgccctggccagaacttccaacactatgttgaataggagtggtgagagagggcatccttgtcttgtgcccattttctaagggaatgcttccagtttttgcccattcagtatgatatgggctgtgggtttgtcataaatagctcttattattttgagataagttccatcaatacctagcttattgagtttttagcatgaagggctgttgaattttgttgaaggccttttctgtacctactgagataatcatatggtttttgtcattggttctgtttatgtgatggattatgtttattgatttgtgtatgttgaaccaaccttgcatcctagggaggaagctgatttgattgtggtggataagctttttgatgtgctgctggattcagtttgcctgtattttattgaggattttagcctcgatattcatcaggaatattggcctgaaattttattttcttgttgggtctctgccagattttggtatcaggatgaggctggcctcataaaatgagttagggaggagtccctctttttctattgtttgaaatagtttcagaaggaatggtaccagcttctctttgcacatctggtagaattcggctgtgaatctgtctggtcctgggcttgtgttggttgctaggctattaattactgcctcaatttcagaaattgttattggtctattcagggattcaacttcttcctggtttagtcttgggagggtttatgtgtccagggatttatccatttcttctagattttctagtttatatgcatagaggtatttatagcattttctgatggtagcttgtatttctgtgggatcagtggtgatatcccctttatcatttatttaaatacaaaagatttttcaataaaaatgattaaagtagcaggatagaacaatctttgcagagaaaatcccaaactctaagtggatggatgctgagactgtatgcaaaaacgctaaattctagaaagagttaaatttgaaaatatctattcttattacaaaatattgatctagtggttgttgggaaaatataaatgtaccatataataaattgggtttggattattaaaattctattaccttgtccacaatggaagcaagaatataaatgactttataaaactaaaaagttttaaattttcttctgtacattggcatatctcacaaaggaatggaattggttacactgcatatgagaacattttgatgcagtataatcttttattgtgcagctttatatagcaccctttcctgaaagagtgactgtacagcgcctggtgttctaaatccagtcgctaactcaaaccttttcactttcataaagaggttttgggaatgaagttaatattccatttaccaaactaaaatataatattatgtgctgcaatgctgtgagcccacccacccaccagactgcagataatcttctattcatatgctcaaatcaagtactatgcatatttctagctcactatcaaaagtaactgcacatatacacaaagaaaggatagaagaaaatgaatgagcagtcaaaaatgactgcaggcgactttaacaatacaagatcagccatttttgacaaatatttgatttgaaattcactgatcttctattaggactcaagggctggcaggagtaacgaatttcctgagcttctcttatgtatgttcagaagtattggatcagtttttggtctcggggtaacaacaatagcagcaaaacagtaacagcaaccaacatgcactgagtttacttcacaccagcactcaggcagaacttctgcttcagcagggtgaataagagcccccaaaggtatcagatcctaatccctggaacctgtaaattatgccttattaggagacaggaacttgcagttgtgattaacttaaggatcctgagatggggagattaccatggattatctggatgggccctaaatacaaacacatgtatcttataaaatagatggaaagggagctttgacagacaaaagaggaggaggcattgtgaccacagaggcagaaattggagtgatgtgggcacaaatcagggtatgctgacagccgccagatgctagaagaggtaaggaacatattaccctctagagcttctggagggaatgagcccctgctgacaccttgattttgcccaagtgatacttattttgaattcctgttctccaaaacttggagagaagataaatgttttttttagccagcaagttcatggtaatttgttacagcagccatgggaaactaaattaagcatccaaccattgaactaatatactaatatattgctgaactttggttcattccttcataagcctcccaaattcttgatttctttgttctgtgggggctgctgctggtaagagtagagctattaaagcatccttccatgtgaagcatcacctgctgacatttttgcagaatcccttccattgtcagccctacctacttacaagttgaaattgacacacaggtgcagtgagtcaaggtctgacttgaatgctttgcttttctctcagtagattttcttaaattcagcaagtcctcacttaatgtcatggataagatcttggagattgcaactgtaattgaaactatgtataaagaaaccaatttgaccacagtcaaatcaatataaacaagagttcagttcctatggtatatttctggtcaaagaaagtaatcaccaaacttctaaataaagaagcaaatacttctaatattaaacatcaaaataaatgggagctatacatacatttaagaaatattaatgaaaaggaagatgatgatttacccaattattccagttcaaggtcgcctgtcccggcaactcagggcaccaggtgggaacgcaccctggacgggacaccctcccatcgcagggcatactcacacccacattcgcactcactcagactgggaccatgtagacttgccaattcacctagcattaagcacatccttgggccgtggaaggaaaccggagtgcctggagaaaacccatgcagtcatggggagaacaagcaaactccacgcagacagtgacccgggctgggagtcaattttttttcttatcaacatcataaggaaacagcattacaggaaatggtgtaacttgaggacttgctctatagaactacacatgccattatttcagtatgtttcttttcttgtttgatctcattcatttgcacacttgaatccaccaataattaaaaacatctgtgaatataatcaatacataagtaatgaatttattgtttctttgggccagaaaactgttaagaacttgttatatgcaaggcattggtttagaaaccagatattcaatgataaattcttgacctcacttaaattcttattgagatgaaaagaaatattatcaagtcacaaacagtacaaagctgggtgtgaaaatgccataaggagaagatggagacaacgctgacattcagatttctggcttaaatgactgaaaaaatagtgatgccatttactgacatgggaactgcaggagaagcagcagatttgggaagagcagtggatttgaggtccctggggggcatccacgtggaaaaacaggcctgatgttaaggagagagaacttagaggttttgaaattatctgggcattggtgataattaaaatcctaggaatggaactcattgctcctggacattgcataatgggagaagaaaagagaggcttagaaaaagtacagggctagtaaagcgtatcgcatattaagagaatgatgactaacctaatttgagatttaaagggatctgataggagataaattaaaaatcagttgggtctatccaaagaggataaccctatatgccagcctccaaaatttagactttttttttttttggtcatatgtattgagtcatagttagaggttttaatttggggactagtaggattatagctatgcttataaggtaaatccagggtagtgtgtaggatggacattagagagaaaagacagaggctgaagagttgagttggaatgttaatgtgatgatctagaattagaggtaatgaaggcctgaagaactgttttaacagtgtgtgtatgtaggtatgtgtgtgtgtgtgtgtgtgtgtgtgtgtgtgtgtgtattttccccccaaatatactaaataaaattggtatcaacatttcttatcaacactatagggaaacagcattaaaggaaattatgttacttaaggtacttgaggtttgatgttcactcaaacacttttgagtatttatttctgcattaaaggtcttgcatttcatacatacaggtgaaaaaagaggaaggcaagatgtcaagagaaaaaaatgtggcatatggcctgacccagtttatttgttgagaactttgtggaagcaggatcagtaggatgcgctgcgatgtatcctggcagtggagaggaaagttaataataaccatagccacgggatgaacagtggctgctcactgagtgttgctaagggccatcaagaggtgaatgaaaagaattatccttttgttcccttcatggagatgctggcaaatgaactgaatttaactcaatgaaccacaaagcctaagggtaactgttttcctttgtggtttgcttattgaaagtcactgctgagctgatacgggtgttggggacaatgtctttgaccttggagttcttaaaaccatcctcagactcaatgaacagttggtaaggttttaggaatgtcctagcaaaagcactctggattctgcaggcaagtgggataattcctgaagtattattttaaaaattgtgtgaaacagtggaaatacactatttggagtcagatagatgagggtttgagtgccatttctatcacttggtgatcctgagaaaatcagtctccttaagccttaggcaaaatggggataatgatcgattttgtgaaaatgttaataaaataatatatggaaaaataatatatttgaatttatagatgagacttaatagataaatgtgactgccctcccatacttaaggtcactaaaaatattaattaagagtatgttgaatagaagaatttggaaaagaaaatcaagctagagagaatgggagaaatttccttaagaaacaaaacataaaattttattaggactatttgatttgcttaactgaaactctatcaaaagccattttctggtttttacatgaatcttcaaatatttctaatcagcagtttttctcttaactgccactcagcttttggttggatgatgcagagatgtaggtgtttcgagtaactaatacaattcccttctagggtatgttgcagggtgccttaacttactgtgtatgcaaggtaaataactcctaatatgagacaacaaacaaaatacatgtctaatcaattcagaaaaatgtttaggaagctccataaacatgttttcataaacgcttgctggcagccaacttgcctggctttcagagttgctataacaaccagcagtcctctcagcagccttggcactctgcattcttacatcttttaataagaaatatcattatcttgtctgggctcattagctcaattatttaaagcatggtactagtaaagccaaggtagagggttcaaaagtatgcattagcaagaaaattctatccatgtgtcctttgccaaggcgacttgttcattcattcattcatttaaaaatatttattgaatgtctgccatgtgccaggttctgttctaggagctagaaataaatcagtaaaattaaaaaaaaaatatatatatatatataaacatgtatataaaccaacaaaacaacaacaacaaaaaaccaacaaaaaaaccccaaaaaaacaaaaataattaagatgccagttttagtgatgtctatagtctggtttgaggggcaagaagggagacagatgctgactaagcaacaaattaatatacatgtagaaatacatgtagagtgagaacaatgaagacaaagcagggaaaggagacaggtgctgtgttagggtgaggagaaagtgcctcttgatatggtgacattagagcagagatttcgatgaattgaataagaaaagctgtagctaagtcatggaagaacgttttaaacagaaggttagcagggcacaagctctgaggtgagagtgtgcttggccggatcaggaccagccaggagacctgtatgactggggtattagtcagggttctctaaagggacagaactaagtggatagatgaatatatgaaggggagtttattaaggagtattgactcacaagatcataaggtgaagtcccacaataggccacctgcaagctgaggagccaggaaaccagtccaagtccccaaacctcaaaagtaggaaggtagatagtgcagctttcagtctgtggcctaaggcccgagagcccctggcaaatcactggtataagtgcaagagtccaaaagccgacgaatctggagtctgatgtatgagggcaggaagcatagtacaggagaaagatggaggccagaagactcagccagtctagtcctttcacgttcccctgcctgcttttatcccagccacactggaagttgattagatggtgcccacccagattgagggtgggtctgcctctcccaacccactgactttggcaacaccctcacaaacacacccaggaacaatacattgcatccttcaacccaatgaagttgacactcaattgtaaccatcacaattggagtggagtgctcaagggaagaacagaaggtgatgaaatcagacaggaagagatgatctgtccatgcagggtcttggaaaccactgtaagggattttagattttattctgagtgagacaggaaacgaatgcagagttctgagtaaaggggtaatataatctgacatctactttaggaaaaattgctttggatccagagactctacgtaggggctcaagaaggaaaggggatctgttaggaggttattgcaattaaacagaggagaggtgatgacagcttagagcaggtgccaaggatttaagaaataatcagactctggatgtttttagaggtagtgccagtgggatttgctgatgaaataaatgtgaagtttttctcttgagcactagaaaaatgaagacagcatttccgccctggggaagactgaaaaataaaagcatgcacaaacttatttgtgtgcatgtgtgtgtgtgtgtgtatgtgtgtaaggcagaatggagttgtggatgccttaatgttgagatttctgtgagacatctaagtggatactttcatctaggcaactaaatgtaaataataaaatctctttatagatttcagagttcaggagagatgtctgggctaaagatacaactgtaagagtcatcagtttatagatgtaatgtaagccacgggtctgaataaggacacctaggaagtaaaaatgatagagaatagaacacaaagaactgagcctttgggtaatacaatgttagacttgggaaagataggggaggggcatccaaaaggagagaatgagaaggaatggcctgcaagatggaaaaaccaagagataatgggggtattggaagaaaattaattcaatatgaaggaatttatcagttaagtcaaatgctgatgataggtcatataaaatgagggctgagaattgacaaattcggcaatgggaaagtcactgatgactgtagttagatcacttttagtagggtggaaaagagaaaaatttcctgttaaagagagaatagaggtgaagatggtgattacaagatcttttgggaggttttgctataaagtgagctgaaaaattggacagtaactgggggtaatgtagggtaaacagaattttaaaaattcaaatgaggacttattgtgacatgtttgcatgctgatgaggataatcgacagagaggggaaaattgatgatgtgcgtgagagcaggggtagtgaagcctttgagtagacaagaggggccacatagtttaaatgtgggaaatttcattcattcattccaaaaagttaagcaaacatctaccatgtgccaaatacacagctaagtactaggaacacagaaatgaataaaacatggttcccattatcaaagaagtcatttctttgggagggagaataagcattttctctaattaataattcacgttcaatgcagtgatggtaatgtcagagaaatgtacccagggctcttttctgggatcttttcattacagcatgctgaatcttgggctgccatgtcattagaagcctagattcaagaccttcatttccatcatgcattgacatgttctgggctgtactactgatgagactgatttaggcaagagttctgggcatgaattggtgctgtggctgcacagataaagtcgaggtgatagatttgagaactgtgtgctaggtaaatcagcaatcctggtgattggttgacttgaagtaaggtaaagaagagggaggctcaaggataactcctaggtttcccatatttagttttatcctggaagcgaggatgctgataaacagattcctaacaggtagcgtgggtggataagaagaagaatctgggcccttttcttaaaaaaaattaaggtctgataaatacctgatactttcaaaaatatttgaaagcagccagatatttctgtctataaaaagaaaaaaaaaatagacctgatctctataggatgtcacaaacgctcaaaaaataaaagataggaaagactaataatacaatgctagaacactttttgatactacctaagagacttaagaaaaaaaacaccaaacccccaaaacacagagttcttggtatgatgtatttgtttttccatagaatggtttgagaaattcagtgaaaattaattggaacatgtggttgtcattcacatggttccagactttatgggcttaataaaaacattatgaatagtttttggagttttgggagaagcgaacatggctggtctaggtatctgcttttaggttaatccctctacgcaggaagtttcacagtgtcatacagtgcttttcaatttttcccactcaaatgctcccactatcagagggatgagaatgagcttccctggatggcagaggaagaaagggggtagggtagtctgagggtgtaacttgaagtttcaagttgcaaacataaagtttcctttaagtctagtatttcaatttaacagtttagcaaattttctgtgcaattccgtaaaatattcatttctttcatatagaaataatagagtctccccctccccccaccttaccctgctctgaatcactgagtaaaacctatgcatggcgaagatatgtcatgttttatctcatgactttgattgcatccttgtatcctgtcacaaagcaggggaaggggaaagacacagaaccaagtttcaggaggcctggactcttctacgccagttcgacatttattttttaattttctttgcactctacttatttccaagaggagttttggagttgctgtaagacttttagaaaatataaatgatctgtgccttgatttccttatttctaaaaacaaagaagttactctacatgatctctatattcccttcttatcgattaagagtctacccacttttggtccaagcaaaatgttaacagggctagtggatggtggtaccaaatgtatactggtaaccgatcaattaacattttggaaaaaatggaatattcagctaagatttgagtcatgatggaaaccttgaatttaaaaaaaactaaccttgggagattattagaacttagaatccacatatttgacatgtgctgtaaaaagaggttatttcttgagaagtagaattgcaactttctgctgaaaaaatatcaatcctccaaggcatcctcagtaagcccacaggcaaactcccacctcagcagactgaataatttgcctataaaatatcacgttgaatttgggaggctgaatatggtgggaaaagtttcatgtaggagaggacctgccctggagatgctcgctgaggtggcaaaggcaactggactctcaaagtagtcctccgtttaacaacatccctttctcaggtacttctctcatctgcccgattacttttttttttaaagcctgacaggaatgatgcttccagattctgagatggtaacaatgatctaaatagactgtcatcatttatcagcattcacaaagagaaaacagctatgaatttccagtgggaaaaaaaactttagaatcaaaaaagcaaaaggtacataatgctgtatccagtgaaaacttataaaagtgtaatgttcgctttaaacacaatacaccaccctgagagggttgccttcagtaaggaattgttttcctctgggaaggaaatcactggcaataccaaatctataaggagtgccttagaaacttggctgcaccaagggccgtgtagttttgggaaaactcagcctgttttctttgtctctagacattttttagacttgataatccctcacatgggtgttggggtgtcttcaaggtctccaactctgtgctgtacttcgatcagcaaatgcttggggagaatttctgttttgattgcatctgccatttgcctccacaaattagacttttttaaataaaatgtaatccttttttgctgagacaaggatgaacacaatttattttgaaaagatacataaaatgtattataaaagacacaatgtgcaaaccagaaattgaaaactaaaaacgaacatcacctacacagaaaattctaagttcttaaaccagttggttgaacgaccttgggcaagttgtttaacttctttgaatcaatttcttctttatctgtaaaataaatacttataatcgtttcaagaaagtttattgactagaatccctggagccattcaaacagattcatattagccctcagcgtggctaatggcttcatctcaattctaagtgcggcacatactttcttgaaagtattgttaagtatttattttatagatgaaaactggttaaaaactacacagtagctgcatactgtaatggattctgaaaaggcctagttcaaactctgaccttctataaataacattgtggcctgccatatgaaaagacagtattgctagtgtcctgttgctgcatgggtgatgaaattaggacacggaccatgaatgagttgcctgattctgaatcagactatcaggcagtacagaaggatgccttcctctaagagttcattatttcctattagaatgctgtgtgtgctgcacatagaattgaggtggagcccttagccacactgatggctaatttgaacctgtttgaatggctccagggattccagccaataaacagaaacttgtctgttcatctgtacattcctctcaaattggttgaaataaatcctcaacacttgatgtttctgacctggttcacagatactcaggagcagcctgtggtatagcattatgagaaattttccagtctgttgagtagaagtaatccaatcctgtcactgtttgtggtagaaaggagagagaatatagagatgagatccaagaaaacaagaaaagttctgaggcctagaagaagtggaattctgtggcaaaaagtctggagaaactgaatttgagtttatggaaaaagccaaaagacagaacatcctggagaatagagccactctttgactggaagcttggaggatgattgtgagtagaatggcctatgtctaattctacatgcaggaggatggagcaggtggggccgtttcagggccaggaaagggtctcccttctactggactgggatgaaacaagagccaaggaacaaattgagttgcagtagcagatagaggaggtccagtctgagggtaaagcatggtgtccaagtagcattcagcaatggcagagcataaagtagatagttccaactggtagcccaagataaagaagcattcaaatgtatgcctgtggatggtgttcccttcccacaaggcacagaggattctgggtcaggcatcactcagagttccagagggaagggtatacatctgtcaatgcatagcaggtctcagttattcagcccaaagcaaaccattggctaaaacctttgataaaaagaaatgtgacatgtagcatggagggtggggcaagactgaggctcaggaatgggacagggcctgtcagaattaccagaagtgaggcagcaccacaagactagatcagcagcaagagttatttgaggtgcagtcacaaaaggtgagttagaatttaaatacatgccactttgggtctgatttggtcttaagtgtgtaggccaaggctcagtcttgaggtagagcatgatctcatttgtggtaagttgagagtatgctgaaattcagcatgaaaatggagatcagagatcctccaccttgctgtcagtctagacagagactgaaaaactgggttaaaactttaaagtctttatatcttggatatggagataaacaaggtaatactgcctggataaataggggaagaagctatcaaaatggtattgatctttccatttaagactatctattaccattcatctcttcaacatttgaaaagatgttcagtataacattgggattttaagtgatgattgtatcaaaaaatgataagtttaaaacattttaaacttatcagtgcacaagaacgggatgaatgcttatccagtatttctttctgtatttattatttgagtaaatcatgagtaataggttggtcccttatttaaaattttagttatggtcaattttaagaggaacacaataatctttttttttgtcttctgtacagttatatcaattttagcagtttggtgtctagttttaccaatgctattttatgatctttgccatttgccatggtacaatgtgtttaaatggcacatcaaggtatactgatggttgccatttgcttaataacttaaaagtaatccagcaatttcttccacttttatttcttaacatatgattttgttttgtgaaacatgaaagatgagtcttatatttaggaaccatttggttgggaagctgggagagtaaaatttaattgattttttttcttctgcagctcttgaagaaatagcatgtgaatccagattaggtggcatcatgtatatttttgtaaaaggaatttttacttgcttaggctgaattcatccttataagcctccctcagccatccttaattcctccctttctctcactcctgaagtcaaggattactatgttttattcctttttctgctgcaatatcccggactcttctctgtccatcactatagccacatcagctaataagctcctcttcctgtgtccttcttccctctctactcatcctctatagtgccatcaaagtcagagtattaataaacaaatcctgacatgtcagtgtgcttactccccacattttgaacggattaagttcaaatgcctcacaggatggcatttgaggtgctgatcctaatttatctttctaaccttgtttcttgcctctttcttccattcctcacatgcaaacactgaactccagtaacaccactttgtcttctcaacatactctgcactattgtgtcttcatgccccttggtacatgctatttcctctgcccagatattcttcctgggcttctgtacctgttgaccccttcaactcatcctttaaggactggttcaaagaccacttctgtgacatcatccctgattcccacagagttaaacaagacttctatgacacgccacagcatctgaaatacatctgtgctggaaacttctactatattgccttgtaatgatttgttagtgaacctctctcttccacttggtctgtagctccagaaaaccagtggctgtttgttgcctactcgtctttgctttattcttccttctgcctgtccacctgctctcccaacatccaggggccaggacagtccctggcacacaatgaacacccaacaaacacttggtttaagcaatgaattattatcttgcacgagatttcatgagtctctttagttttgctttcttaacttacttaatgcttattaagatgacttttcactttcagttcttcctgtttgattccagttcttagtcatgtcttccccttggcacaaaactgattgagcaatatatgctgaagcctcactcttcaaatttcatgacaaagtctgagggtcccaggactttggccaagcacaaatagtaagtgtctgggaggcatcaactaaattatctgccagtgaaaatgctctgtcttctttgtctcagttgtttatgcagaacaaccaaccgttcctgtaaagttatttttcctaatttttagcctaaacttttcaatagatacaggccatttctccctgtctcctcctatctcctcatcttctgagactgtaaattatcctgtaacttcatttataatgggaacatatttattttctgtgatgatggctcccctgagcctttctttttcttagctacataaagttaacttcctctgtggcaaattaaggacagattacaagcagcctgggaaccgggctccgtcaccacagggggccgcctactcagcctccttctgttcagccatgggaaagatgcagctgctaagccagccgggtgctgggctgctctccccctgcctctcctgatccctcggagggagttgagaagtccctttctccatcagtctctggttggtgtctgatgctctgttttctagcctctcttcttctgctcctcccctcccccagctgcctaccaactccttcccacccccaggccagcagtgactgcctccaagactccccctccttccagcaccgcctcatggtttccatggcaacagaaaatgttggtgggaagcaaaaatgctgaactgcaactcgtgttggggctgggaggaggaggtgaaatgtgggcctctctggaggctgtagaaaggtggggagaaagaagccaggtgagaagccctgagaagaaaggaccacgaggctcgaaaggaaggtgcattggcaagcggggatcactttgatcagaaaaatcagctaggaggaagaaataggaaagagttataaaaagtaatagagaatcctgggccgggtgaagtggctcacacctgtaatcccagaactttgggaggctgagatgagaggactgcttgagcccaggagtttgagaccggcttagacaacatagcgagaccttgtccccgccttcaaaaaaaaaaaaaagtaatgaagaatcctatatatagtggttgattgagggattacgttaggtataaaactgggaataggtgactttatattgaaggtgagtagtgaaagtcaacaaacatagtggccaaaaaaaggggggcttgagagtttaacaataatatacatacatgaaaaacaaaagtaatattaacagatctgggcttgtaaattaactattgtccttacttatcagccaagtgttacttatcttctctgagccttagtcttctttttgcttgtctattaatatagtgttatcaatatccacctcaaaaagttgttgtgaggatcaagtttaaataaagcacataaagtggccactcatatagcaggtaaggtaggaatttttcttttaaccattgtatgaggttgaggaatggtacttcaaatgggtcttggagctggaaacttaaaattcattgaaaactgtgccttgtcatatatttgatttttgtatttatttcaattttccatatctcttaagtatatggcaacatggtttttttttttcttttttttctttttctttctttctttttttttttttgagacagagtattgctctgtcgcccaggctggagtacagtggtgcgatctcggctcactgcaacctctgcctcccaggttcaagcaattcttccgcctcagcctcccaagtagctgggattacaggaacatgccaccacgcccagctatttttttgtatttttagtagagacagggtttcaccatgttggtcaggctggtctcaaactcctgacctcaggtgatccacctgcctcggcctcccaaagtgctgggattacaggcgtgagccaccatgcccagccagcatcatgtgactacgtccctaagtacatagtaccatggcaatatttagtgttaaccccttcataaaaaataagaagaaccatcctttccttttaaataacctccctgtctgtgcttttcaagaagcctgtggtgttgactcattctctctcctttacagccacaatattgttggcatcataacttctcatttcttttctctctcttcagtgaaaggggttgctgcagaaattatgttctaaacccacaatcatgtttataatggtccacgaatattttttgactgaatgtctgtgtcatcacttccttcagaagtccaaggcaagaaaagctaagaagttgtggcccaactagagatgcccataagcctatttactccgggctgtctctttgcaatcttagaagatgtcaagttactgcagaggctctacttcatgcctccttttcctgaaattgggacaataatagcaacgatgataactagcgcctgaacttgttgttccaaagtgcctgacatgaatggaatcatataaacttcaactcaacccaatggaattagcatgttgttaccgtgacggtttccacatgtggaaactgaagcacagagacattaagtaattttcttaaggtaatatacctcgtaagtttcagggctggaatttgaatctaggcagaatctacctccttaatcatctccactgtgctaccctctagggaagaaatatctggaactgtggcttgatgatattactactgctttttatagacaacgatttttttcctcacttggtatcatctaatgaataaagaaggaacgtgttactgtacttctatttcaagatgtgtactgagcccattggtttatcttttttctcctcttagatcccagtaaaaaaagctaaaaaaagaattcatgatctaacaataatgaggataattggagaaaagctatatggatctgggagatttcaataaatttccagaagtcagaaagagcgtggaaagatgatgcagtggggcagaggtagctttgggctagtgtgtttgcagagggtcctgaatcaaaaaaagagcccaagttgcccatcagaacctcggaagtttcagtctgagagaatggagatgggatggaggaggagatagagaagtgagtagaaaatgaggatgaatttaaaggtctgtgtattgaacagctgcccacctgcctgtaacacacatatccccaccccaatctctctttctctctctgtttctctctgtctctatccctttctgtctctctctctctctctcacacacacacacacacacacacacacacacacacacacacacacacacacacaccaggcatttaccctccattctcaggtcaaaaaggaagtaaggctaactctctaaagacattttaaaaagcctttctggggagagctggagcaactagtacagtggtgtttgggacaccctgatcattatagggacattctgctcaccacaacacaaaacctggaaattaaaaaaaaatgcacacagaatttccagtttgcttttccattgcctcttcctgaaatatgaacagaaaatcacaaactacagtcattagaggatagcttttagcacgagcgacaaagatcaaatgggaaataatgcacagcagaaaaactaactcaaaagacaattccaataatctcaatataaaaataactaacctctaactggtgtttctaacaggttcaaaacaatacatcagaggaaaaagaaaagggtgccaaaaaaggaatagagaaaaagagccttgagaaattgaaaatattattgccaaaattttaaaaatctatttaaacattgaaagcaatctcctagagtgtaagatgaaaatacaaagagttggtaaatgtgagcacaaggataaaagacatggaggaatgatggaagaaatccaacacctgcctaggaagatttcacaaaaaaggcaattgaaacgaagagatagatagaaatgatcaaagaaataatagaagggaatttcccaaaatgtacctttatatttaaagtgcctaccaagtgtggaacaggatgaaaaagacacccactcagtcacatcttagtgacacatcaggacactgaggataaagagaagatcctgaaacttccagagagggagaaaggtcaccgataaaagaaacaacgtcagactcctcatcaaacacatcaaacactgtaagacaagagagcattgtcttccatactcagaaaaattacatccggccttgaatgacatactaagccacgctattaatcaaccacaggggcagaatatgggcatttttagattcacaaagggttagaaattaatctttcatgtatttctcagctgtttcttttataaacagttatttgaatgtgtgctctggcaatatgaaaaatgacacagggaggaaagcatccaagaaacagtggattcaatggaggactgcaatgaagagagtcccaaaatgatgaatgtgtggcagtctcagagaacaggtccagcttcggacaggaagactaaggattaatgtgtggcagtctcagagaacagcccagcttcggacaggaagactaaggagatgggtcccaggaaaaatgtagatcagaaaaacagatagtatgatggagactatgaaaatcttaaggataaagtaaagataggaaatgcaagatgaaggaaaagtaatcagagatgacaggaaagattaaacagggttaaagattaaacaagattaaaaaaggtaagttctaggataactctaatgttcccagtaactgtgcaaatgggtgtaaccatcattatcatgggtgccctgcctctcaggacccaggtatggggttttcattcttgatacggcttcccacaccccacgagttggcatagaagcagagaaatactttcaggtcccaatgcaagcttggatgctgaggacttcagcagggaccaccatacagtacagatttccctgtgtgcctggcagcactaaggtctctagtattatggggtgacaacaggagaagccaatccagatggcaatggaatttcatgctggctttgccatggagtaaaaactaagttgacttgaaacacacacacaaaaaaattatattttgtcgcacttgaatttgtgggctaagattcagtttgcaactgtagtgtgggtagaggaattaggagagagaagagatgatagtattgacaatgtaaatcctcatctctcacatcagaatgtcagtaaataatatctaaagttgataaagccaaaattaagggcatttgcatgttatatggagataaccaccagaaggactaagcacagaaatattgaaagtatttgcttttggagagtggggctgggaacagggagaagaatgcaggaaatggtttgtattaaagttttatttgtatatttgtttgaatgcttgaaaattatatatgtattatttcattttttttaaagtgtgctcctttctgtcaattttactctccttgctacagtgtagttaagttgtccttggcatcattgttcctgtgtctatgtagaccacctgttttggaagaaggtgaggttatcaatcaaacggctaaccagtcacaggcatctactcattcacttgctaagctccttcctcattctcgtttccaagagtgctttcaaggacacaagagaagaccctatttagtgctgtcattgtcttggttgtgcggtaacaggaagcagagaagccttaatttttagcatctagacttcagctccaaatactgccattgaaatgggaagctctgattacagcttctaaagtgcactgttttctctgtgctacagaactgtcttctgaattagtatcaataaaacgctttctaacaggatctttgacaccagaagtcaccactgatgccaatgtaattaccatccctggacgctaggccttgtcaggcagcacagataatcacctacaaccaggggccaacgattacccagtcagtcaacgacattgactgctcactgggaggttctgcacgagtaagagagaggagaactgcaatgtcctttcctcaaagtacttcaaactaaacagggctgagggtgtggaggggaaggaaagcagagattcacacacatcaaaagacagaaataaacaaacctatccattctcagttacacagagagggctgtggagatctgagttggcgcagaataaaaatggacttttgcatcgcctggcccctgtttggtaaaaacctccttggttttatgtatttcctcttttcattttttttaaatggtgttatgtatttcctcttttcatttcttcccctgcccactaactgggctcaactactgaataacccctgtgtgccatgctttttctgtgcttccatactaattatatgctgttccgcttgcctgaaagctgttcctatcactcagccctttcagcttgcaaatttttctaatctatcaagaggtaaacctgacctcttctgtggagccttgcctgattcactccattttaattccaatcagttacagtgctgtgagctttgtgagaggagggacagagtatattatcatttgaaaataattaaaattgttaatagatgtaaaacacttagaatagtggtgcctgaaatgtaagcaaatgtgtttattattattattattagcatcattactatgatcaatgtttgtatttagaagccctagcataacatctggcatatgaaagtggaaactaagcaaatgtttctttgtttgaattcttggaacatttcagacaaactgagttttattgatgagaaggttgatgggttttcttggcagtggtcattattccaaggtgaaagtgaggattattgctttagctattgcaactgagaacacagaatatcttttaagaagcagaagctctaataggtgaataaatcattttggaggataggaggatattccagatgatatgaaactattgaaaacagatttgctgttggttttcagaaaatgtactagccctcaggaagatgggcttgtttggagagatacctaatgtaacacaaataacttcattttcttcagcattatctggaatagatggttaattagtctcagacagctgtttccatactcacccgcctttgctgtctgtgtgatgtgcacgtgtgtgctgtcatctgggtgagcctatctgggcacagtgacgggtcattaagctgtcttctcatatggtgcatgtatagtgtctgaagcacagtttcaggagacaggtaacacttccactcagagaggcattacatgacccctagggttgtcaatagatccgtagctcttttgctcttcaaacactacatgcattttgacatctcaccatctttgttcattgttccattcactgttatgtccttcaccccgttctttactgcttacataaatacactcaagcccacttcctccagagatttcaccatcactccagctcatagatatctcttccatctccatcatattcagcttgctttcttctttctttgtctctccctttctccctttctctctttctttttctttctctctcttttttctttttctctctgtctccctccctccctccctcaacctctctctctctatttttctgaaacagagtttcactcagtttcccaggctagaatgcagtggtgtgctcagagttcactgaagccttgaactcttgagcttaagcaatccttgcgcctcagcctctcaagctgctgggactataggccaccatgcccagctaatcaatctttctttctttctttctttttctctttgtttttctttccttccttccttctctttctttccttccttccttctctctttctttcttcttcctctctttcctttcctttcttccttctttcttctctttctctctctctccttctccccttctctcctttctctctttccctaccttccctccctccctccctccctccctccctccctccctcctttctttctttctttctttctttctttctttctttctttctttctttctttctttctttttctttctttctttctttcaagataggagtctcactgtgttgctcagactggtcttcaactcctggtctcaggcaatgctcctgattcagccttccaaactggctgggattacaggtgcaagccactgtgcgcagccagtcatagatttctaacactaatttctccaatagttacattttatattgtgaaaacacttacattgttggcttttattaacatttgaatgtgatttgctatttgctgttaagtatgctagtcttagctccctgagtagactgttggatctttaagcagatgctgtactatggctctttgtagtttctaccacatttagcacagttagatgagtatataggtacttaataggtgttcccttaggaatgaatggataaccctcctgggatccattcaaaaggattctcctgagaactccttaacaaaggcttatctactttctagtttagactgtcaacacatgctaaaggataaaagatgcagatttgaaacacatagatttacattttaaaatgctgtggcatatttgttaatatacttcacagtctgaatgcaagtttaggttagttacccttgaggacaaagctactagactctcgaggattcaaatagtctcataaaaatcatcacaatgttatcattggtagttaagggaacattttataataagtgggtgtctttgagcatgtttcctagggaaagtgctaagtgcaatctagtccatggaagtcccacagtactctgcgaacaacctgcactacttcatggccacttcacctgaatggctcagttctttgagtgtccatgtagtcaactaatcagtctgtggtgagtaagagtaaattaaggtgactaactttccaaagtcctttaaagttatttgatttaaggtcgctgagctaggtggtttatggatatttcagtattcctggaataattcatgtaagctttttccttgtatccaatatattatgagggtaagagcaatgaagccctgtgccaatttctccatttcactggctaatcagtaattctaacattgtttgccagctaaatggaacaggcactcttgtcaccatcatgattcattgcctactgaaagcacagagctggccttaatctaattcttaataaaaccttgcgaactaggtatactgtctcaatttgcacacggaaaacagatgttcacgaaggttgagggactggcccacgatctcacaccaagtaggtaaagaaccatggaagcaattctgtgccttaaagtgcaattgtctttctaattcctgtggagcatgattgtcttttccatgctgaatctaatgattacaaatatcaaatgagccctaagcatggccctgtaatcctactccattctcctagtaaactctccttcccactctctgaaacaactttttaatatcttctctatccttatatcttctacatccttacagcattattcactagaaaacagaaaccatcagaagaaacatatttccatattctcaatgcctcatataccagtcatgatggtacccactctctctgtcttccctcctgttatcacaggaatgtccccattagcaaccaactctccacttggctctggatcccaacctctctcatctttattctttccatccttctttcttttccaatatcaatacctctttttctacctaatcattcctttcagtagccaaacatgactccagtctctcctgttttaaaaaattcttccctttgccccacaagtcaccctttagctattagtgtatttccgtactcccattatcagaaaaacttcttttgacagttgtctactacttcttctatccaatgcaacatggcttccgtggctctcatttcacagaatgtgctcttgttaagttctccaggagcctctgtgttgccaaattcagtggctacttctctagtctcatttctttttttttttttcaccttcaacttttattttaagttcctagggtatatgtataggatgtgcaggtttgttacataggtaaatgtatgtcttggtggtttgctgcacagatcaaccaatcacccaggtattaagcccagcataccttaactattcttcctgatgctctccctcccccaacccccacccctgataggccccagtgtgtgttgttccccaccatgtgtccatgtgttctcatcattcagctcccatttataaatgagaacgggcagtgtttggttttctgttcctgtgttagtttgctgaggataatggcttccagctcaatccacatccctgcggagaacatgttatcataccttttcatggctgcatagtattctatggagtatatgtactacattttctttttccagtctatcattgataggcatttcggttgattctcatttgatctctcatcagcattctacctaactgataactttcccatggagcaagtttttcccatggagcaagctttcccatggagcaagcttttggtagcattctacctgataactttcccatggagcaagctttctaaacactttgagtttgaggggtcagtagaatatataggaggtagaaaactttgcttctgttgagtatcggtgaagtaacctaaggtgaaagtgcagagtgagaagagaagagactcaagggctaagcctgagggtacaggcggaagcagggagggctacaaggaagactgagaaggtaggaggagataacagagacaaggttagaagtcaaggacaaaaagagttgtcataaaaaaaaaaaagtggtcagaatcaaaggccagagaaagatcgggtaaacagggactagtaaaagtatattgtctttggcaattgagagtttattggttgccatttataaataatttcaggatgatgacagaggctgatggtattaaggcctgattgtatttttctgaagagcaaaccagcaagtgtaggcattattttgggaggcttggttatgaagggaagaagagtaagtggatagtgtctagagcagaataagaattgaggaaggttttgaaaaaaaatcaggttatatctgagtttgctcagagagggtagagaagaaggcttccctaatatcacagcattatgcaagaactaaaaatagaatctatttcttctgcctccaagataattgagataatacatgtgtaagagtttaaaaaactataaagtacaataagaatttgatatagtgttcttctttccactatattacaattaattaccaggaagtcaatggattgcatttttaactatataacacaccctttaccccactccctgcaacaagaacctcactgctatttattcagcagttcttaaatgattgatttgttgtggatgatcttttgcttgcttccttttgaaacagtgagggatttctggatgtttgccagcctgaatattcctgtttacttgtcttaggctaacagataactggatgggccatattgttatacaggcctgatgaatgccaaatgttcagctctatctctacaggattacacctttctgaaaaaagaatgtataatataacttctgtcaaataaacttgagatacatttgtttctagtcctcagatttcaagatctcccttaagactttggaaggacaagcctaattctctttgccaggcatgaaaccagacattagcttataaactcaagatgttccataattctttcaatatgaattctaattatctttgctccttctaagagaaggtaaaagtataacaatgtgaaatctaattctatggactcaaggggcagaaatcagtgacctgatattcagaggcctatattaattatccattttatttttctcacctctgtaatttgtaagtagagttgcaagggctcttgttcttcagttactattttagatcatacactctcaaatgaatggatagttctcaatgcctgcgatgcgcttgattcacacagactagcctaggttgtctgaaatgaagtcagggagacgcatgcaatgacctgtaaggtgttgtttctgtgtctttgtagcctgagttttcttgtggataaaaatctatagccttttattatgacagctcattacaccacagaaaaaactaaactgaaagatagatcatgtcttccatgatcactgctactgtttgatgtggtgtctcctgcatgaatgaaatgactgccactcagaaggtctcatggtctgagaacaaacttgacctggaaattcatctgtatttttacaaccctgtgtatggtgagaaagtttccttagtctagactgcttaatatctgtataaggccatttttttcttctctctcacctctcttgttgatactcctctgaatcatcatccacccaagatcaaggaatgctcacgctacttttgtttgtccagggctcagatctttctcagctcactcagatatgttgccccagtatctcttattgaaaacttttccctatggactcagattgacctcagtttaaatcttcagtgctttggaccatatatttagtctttctataactaagttttgcccttgtaaaactggaataatactacatactgtgtaacatttgtgagggggtaaagataatgtatgtgataatcatataacaagttcttgataaacaatagttatattattaaattggctatattttttttctttctataaaacattacttgcctaatcatcaatttccttggagtgcttctatcaggtagttatcaagtgtaaggatggaacccaaataaatatttcttgtaagtgtgatttatttaggtactggaagaggctgcaaaataaaatggaaagagtgtagggctagaaaggtgacaagttcctggttctggtgttgccagttctcatattaaatagcagtgttatctgtatatgattacccatctatgaaaaactctaagttattagaaagattgaattcatcattgatgaaagagatccttcaggcatctggaatcttatgtaaacctcacgtagactgagtttaattcaattaaataactatttattgaatgatcattatggactgtgcttggcaatgtgggggataataaacaaaggctacacatatacacacatttattgagaactgttatgagttgaattgtgtcaccccaaatttatatgttggagttctaacccctagtagatatgtggatatagatacacatcctagtagatatagtaggatgtggccttatttggagatagggtctttacagacataatcaagttaaaatgaggtcattagggtgggccctaatcaaatatgactggtgcatattcgacatgcacagaggaagagatttgaaacacaaggagaaggtgaccaaggagataggtccagaatggctccttcccttatagccctcagaggaaccaaccctgctggcactttggtctcagacttctggcctccagaactgtgagacaataaatttctcttgtttcagccacctagtttgtggttctttgttgtggcagccatagcaaactgatatgaagacctactatgtgctagtaactgggaaactaacactgaacagggcactgttatttgtttcaggggaagaagtttggaaaagaagcagatacttcagtcccatgtaataaacctgctccaagagaagtatgtacaaggtgtcatgggaggacagtgaaggacagttgagtattaccaaaggcttgtttaaggctcctcagcagggacttctaagccaggcctttgaagtaagagtgcaagaatgagtgcaagaagcaagagttctgggcagaaaacagtgtttatatgaggcagtgtatgcaaaggcacagatatctgagcaggtgtggcactgttgtagaactgtaagtaatccaacatggccagagcttaagagcagtgaaagataaggctggagaggtgagcaagttccaggtcagtagcggaaggctccctggagcaaggggagcacctagaaccttgaggtaggtcttccttgattagcaatcgcgaggacataggctatgttaggtaggagggaaactgtaaacaaaagtgaatgcgtatatttatttggcagtgagcattctggtctggttaaagcagacatcctcttgacaagcagagcaagcaagtgagaagctaagaggtaagataaagtctctcaaaggaccagaagtatgacaaacggagtgctttgagggcagggctagtatcttgtttagtgcttgcagtatagcagtggctcaagaaacaatcactgaataagtgaagggagaagtggtgaaattctgtccttttactgaattaagcagggacttttaggttacagaggtttggttttgaaatctaggctctgctggcaatttttttaaccttgttgagtttcatcctctttatttctaattgtgagtatactaatattgaccgtattggtgagaattatatgggataatttatatggaactatatagaattatgggtatactaatacttagcatgggataatttatatggaattttatagaatatatggaactatatagaattatatgaaactatatagaattatgggtatactaatgcttacagtatatggtgagaattatatgggataatttacatggaaatatatagaacttaaaaattccatttgatcaatatttattaagaagctactatatgccaagccctgtggtaggctttaggactagaaagatgaacaagacccaatctctgcctctaaggaatttactttctgttagggggatggggaagcagacatctgaatagataaaagaactgtgatgcaatagaataaggactagcttagggctaagaacagagcaccgtgggtgcacagaggagggacagttacgccagccagacggcaggatagtgttggggaatacttcctgggggaagtgatgcttaagctgattcatgaacaatgatacgcaattaggtgaagaaggaagaaaaaggaattccaaacagagggaacaacaggcttcctttgcagctgtgtttttctagttcctgtgcctgtgcaattccttgctgaaaatatactctagtcggcttggttaaagcaaaaacaccctctctagctctcgtcagactcctgaaggttggatcgtgctctgaacagcctcagctattggctggcttctctttaaactaaacaggccttcagaaacccttcatgtagccacctgcctgatctcctcactccctttctcctgctttctttcttttcttcctgtccttcctcggtatctgctttcttcctcctctcattaaacatttcctatgtctacatgtgtaaactatgggctgtgcctggagatacaggggataaaagcatacatctaactcatgaggagctcgaaactgaaagtagggtcagcgagctatggcccattgaccagatccgcctgtttttgtaaataaagttttattggaacatgcccacgcccatttatctatgtactggctatggctgctttcatgctacaatagctgtgttgtgtagttgcaatagagaccatgtggcttgcaaagcctaaaatatttaccatctggccctttacagaaaaagtttgctggcccctgttctagtgtttatatatggcagaagtggtggggatagatggacaagtaaagaggtaatgtacccctgtaagataagtttttcaaaagggtactatagaaggagagttcctaacccatacttggagattgagaaaagaactgagagctaaaaaaagtgacaagtacgcttagagctaaaggataaaaaggagttaagagggaaaggaagatcattcttggcagagacagtagcatgtgcaaagccaggcaatgaaagaaaaacatgcagttctctattgcaaaaagaggaagcggtgaaagataaggcaggaaaatcagtttgggccaggtcattaaggatcctaaatatgaaaaccatattaaggattttagaaatgccctataatctctcccataggtaactgagaacctttgaaggattttaagcagagtagtgctaaagcaaatgtgtgctctagaaagatcactctggctgtaggatagttaacatttactgggcatttattctatgccaggtctgtgctaaacgctctttgcatttggaaatatctattgagtagctggacagcactgggaaccaggtagaaagaggtgaaacatggagaacagatatggatctatgagaaccagggatctccctaagggatgaaaaggtgtagagcaccacccttatttggaggcatgaggagaagtagaagaacaggggtgattgcaaaggggagtatactgtcatggaacacaaacggggagtaaataacaaggaggagtggatagtgaaaatcagatattgtaaagagagctaagagaagaaaagtggaagaacaagcagggggcagggaactggtaagaagcagatcagagctgacttaaaagagagcaatttcagcagaaaagttgagaaacaagctggattatagggttaaggaagtggttggaagtgagaaaatggaggtcactgccactgaacacttgtttgagagatttgtctttttaaagaagagtagaaatatgactgtggctggatttcttaaaattaggctgtaattcagcagctttggtaacttttctgattcatgaggtaaatttctcatctcaaatatctggtcatttgaagtaatactggagatcaaattacgcaaatatgctgcatgactaaattaaaggcctattcatgtgagcattagttagtaatgggagttgtattatatactgcattattagaaaatggggcagcatattttaatgcttaaaaatttaatcagagcaacttccagaaggaggaaaaggctcctttttaacacaagatttgaatcatggcaatttttttttttttctgaaagccattcttctaagatggtcatccctgcacatgccctcatttctgactttctgctgcacaagcaatcagtattcgtgcaaggctaatgggatatacaagaacaattagtagctctgccagcgccaatattgtacttgcctctttaaagagctcaaaatattaaataacaattggaaagaacatttcttctagactactcattagattgattttacagatgagtaaactgaatcatagagaaacaagatagtggaaatgagaagtcttactttggttctatctcacaccactgtaaggctgtgcctattatatctgtaattaagctgttgtccagataaacaataattcctgcttggctttgacttttagataccaacagatatttaaatgccggcagttgaaaaggttatttttttttctttcaaaagtgggtttgtaactattggcttaaattattttagaaaactatagctgtactttcaacataaggccacccactcaactctgagcctagactgtttgagaaataagaaggtataggaaatttggcaggtatttttctcttgtatctttaaatctcagtaagttcacaaaattttcctaaccaatattggaacaagaaattatcacggggggaggggggtgactaatctcaccttttaaggacaattaatttttctacttcacaagtttaacttcttatttggatcacaatatgctactaagatacttaaaaggtcattttttcaggccaactgcaaatgatgttttcattatagaaaagttatgtaaaagtggaaaagagatgtaagtccattaacgtgtaaaatgcaccatagcaatgggaaaaaagttttaatgaaatacgtatgagctctatcatgcgcaaatgttttgttgaaatggatgactccaagagctctgtggttccacttcagtgtctaataggcactactcactttaaccttcagcaagccctttatgaatgctatccacccaagtgtatgaaaatgccaattcatgtagggctatcagtattattgttatttcttattctgtaaaggctgcattttgaacattttaataagggtcaaagcattccaagtcaatctagatggcaattgttagaaatgcaggaggtgctttaaaaaatgagttggtaataatttcattcttctcccattttgattagtttataaatataactgtcagctagttatcatggtgaggttattggtcagtcctcctccaagtaatataaactccttaatacagtcttcagactatgaatctaccataacattgccagtgttttgatatcatcagtatcttcatcttcctttatttcaagctatgatagattttacctcttctattatctactgtaatttgctgctgacacaccaattgctagtaaatacatatgttgagcgatggtgattatgtgaagaatgaggggcaagatccctgtggtgtagtgtgtgtgcacccatgtgtgcatgaagaaacgtgtgtatgtgtgatgtgcatgcaaataatataggtctgagggaaatactgtactccccttgaaggtaagggtcatgtcttattcactgttacatccctagtacttaacactgtctctggcacagaaatgatatctaaggagtgcttgctgcatgaatgagtgaagggtactaatggtccatgttcccattggcaaaataaggcttccagtttaaaaatgagactggaggtccacctacaacaatctgttgtgctttcagtttttacaggctgatttctacgcacacagcattatgctgggacttgtgaggaaagcaaggaaactgaatacacagaacttggacttgagaagctttcagtctaattggggagacaagatacatacaagtgaaaacttaactcctaattctagagagagaatcatggcatgccaaatgtatttttttcatgtcaaatgtaaccactgcgtgagttcaggagaaaagagcctgttctgtactgcagccattaaagaaagctacctaaactaggcaagaattgagttatacctttgaggataaaagacagcagggaaggaaaggaaatgtctgtccaggaggagcgggtagagaatacagatgagcaaagttattaagataagaatagattctttgggacttaaaatttaggaagcagtcattagactttgaaaaataaatatgatggtagagacaaatataacaaggaaataaataagcatgcacattttgtatagtaatcacttcatacctaaactccttggtgaaaaaaaatgtcgaaacttagacacattctctatgttgcaaactcaggggaagtgagtgaaatgtcagaaggcatggcagcattcccagaggttagtgagtatcaggtaggctttgccaagcaggagggaggtgatgatatttgacttctgaggggataaacaggtaaggtgggatctgggcagattttcagacaaaagattctgttgtgaaggggcttctggttttaacatagatgtgactctccttaagtcttaggtgacctgatgtacttctgaaactattcattgattgtacaaatttctatttattttacatttttaagggcacagaaggatctaaactatgtgcacaactattctacaaaccaaactgaaaatcaaaatgaaatacacaaaggaaaagttgtttgaaattttgtctttaagatacagggaaaaaatcacacatcagtaaaatcaaggataaatatcagcctgaaggaggagcaataattgacaaatatttaaaaacaattgggggccaggtgtggtggctcatgcctgtaatctcagcactttgggaggccaaggcaggcggatcatttaagatcaggagttctagaccagcctggtcgacatggtgaaaccctgtctctactaaaattacaaaaattagccgggtgtggtggtgcacacctgtaatcccagctacttgggaggctgaagcaggagaatcgcttgaactggaaagatggaggctgcagggggctgagatcacaccactgcattccagcctgggtaacaaagtgagactcccactcaaaaaaaaaaaaaaccaaaaacaaaaaacaactggggtctttcttttctaaccatatctagacattggtgaaaatagtccttattaaagataataatagctatggagataaatcatccaagtgttgcatttatgtgtgagagtatgtatgtagaacagatttagcaaataatttttaaagctttcaataaatactttaagtgacttatatggacactttaaatgcacattcattaatggattcttgattgaataaaaaattaactcctgaaaatatttcctaaataaagtacatctatgcatggatgcactatgatgtttcaaccaacattaattatacccttttgatttctactgtcttgttcaaaaacactaataagacatgcactacatcatagttaataggagtgtggtgcttgttgcttaggcaacaggaggaataaatgcaggtcagaatgtgcttcaagaaaaacaaaagctagaatatgatactgagtggagactaagcaagtctaacagatttttcaccacattaaagaaatatgtttcttagagcaagccaatcatattcatgtgtttaactaagtttgcaattacataaattagattatgtagatcaataaataatttttataaaggtagaaattaatcgcttatgatactagtagcaaataaatggtgtataacagcatgtaaagcactaattgattataccacttcatgatttgcttcattttcataattaattaactcctctaaatggcaattcaaagtttttttaaaagataattctgtctcatgaagaaagtatttgattggcccatctaagttaataatattttcttattttctagaaaattataccaaatactttgaattaaacaagtaaagaatataatctatgattagaccttggttacatcatgtatatccaggattttgccttccatataaattttgaagtgcttatacatgattcattcatgaataatttttacgatctctctttgaatgcttatttgaaacctgtttgattaacctttcagttcgaggctttcaaaaaggtattatatttgctcataagtgtttaacattcagaggaaaaataagctgaattaaagtctttcagcttggccaaatgatccaggaaatccaaagacctaacttctcatgggaccagaataaatttggacaagggtttcagggttgggaatgagaaacccttatttcaagtagacatagggagaaataattaagatattgaaatgtacagtaaacataaataataaaaaaagacttcaattctgtttgatagttcttctaattcttaatgccatctgtttagtgtcctaagtctgtcctaaatctgcccagtgttctaagactttcatagcaattgaagaactttcacttttttccatttcaatacccaaatatcttgtctatataaccagtgacagtacttgataaacacaagaaaaataacagtagctgcatatatcagtataaaaaaaccaacaaatcactcataaagcattctgtgcatgcaattacttagagctcatatatcttactatatttatgtcttttttatttttaaaaactcttgggcatacatacttttggagaaggagcagaagttgaataatgttaataatcttcaaatctataatattcaagtcaacctcagagaaaaataatctaagatagaaattaaaaaatctaatcagctgtcactattgtgttatcatttctggtactagtaagctgcaggtgtcagccctattactgtatttaggcagggctattacttatttccacaagtcatttgtgtgttacatgcctgtgttatgtaggtctctctaaacttagggatcagtgatatgtgtgatgggtacttaaaagcaaggaaaggtaatagagctgtgacgtagcttaacaaggggaactgatgagcactgggggaggtatgggaatgattagaaagctgaattgtcggtttgcacagttccccatcctccttcctcacctatatgcaaaacggtggaaagttagcacatgccaggtttagattgcatgtagaccagaattcagaagtacatgactatacttactccaccaacctttctttctaaatattgacagctaaatgaccaaagtgtttattttccacctaaagtaataaacaatacttcatcgctcttcaatcagcaagtggaagtaaacgctctccataattgaccatctgaagcagtttgctaatgaactgaaggttgtccacatgatttaaactgcttattgaacaattatcaggaaaagaaatgatcttcacaccataaacacaacaaattgtctcattaaccactaaatgctgatgctcaagtgaaataatataagaatcaagaattagctgaagagtgatataatccgagtattctaagattacaaatttatttaaaaaatcataccaagaatgacagggagaatatcaatattaatcttctttcactgcctataaatagcactctcaccagttcattcatataacacatatgtatatggatacatacagatctcattttttagcaagagtctatatgtacacagcaagttcagtcctaagggcatccaattttccaatgcagttacatatataaatctgaccagttttggtgcaaatcaggctgcctctgagccatgtaagacacataagaagcaaagacagacaaaaggcagctccgtggacacagagagcttcttaccataaactgcacattgtcaaatccattagccatcaggtggttctcgtactgaggtagcccaatgctttccaaccattgtcccactgtttggacagggcatctgggtcctgtaagaggatgaagagggaagcgtttaagcagggagtagccgtccacggggtaatagcggtagtcctgggctgagaggtggcattgccacatcatgcccctgggaaagttgctatcaaaggagcccgccagcttgacagattaatgttctcagcgagagagcaaagtcagaagtaaaacatagtttgccaggcaggctgtggagtatgacttgatcctagctccacatttcttacatattaatctttactaccgaccagtacgtcatacagcccccaaaaccaggcagcagaagaaggcatatcaagctgtcagcttgggctggtctgcgttctatgtgattgttggagtactccacaatgagcaatgcacggccggcagccagaattcttttttatcaagtactcctacactcatcagtatgcagctccatgctccttgctccccctcgctcgctccccttcattaccc

SEQ ID NO: 1720 - DNA, 150924 bp, Homo sapiens
ctgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccac

SEQ ID NO: 1721 - DNA, 150924 bp, Homo sapiens; identical to SEQ ID NO: 1720

SEQ ID NO: 1722 - DNA, 410827 bp, Homo sapiens; identical to SEQ ID NO: 1718

SEQ ID NO: 1723 - DNA, 150924 bp, Homo sapiens; identical to SEQ ID NO: 1720

SEQ ID NO: 1724 - DNA, 411118 bp, Homo sapiens
ctgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccggtggccctctcctgtgggacttgcgttccagctgttctcagagcgggtatgatcggcctccagtagacttggagggtcacgggtgagattttgataaggttcaaatactcctcactcctgcctccggtttccaccaaagttaccattgtactactaccaacagttgtggaaatttactttggcaaaggttttgtgtttttgtttgtttgtttttccccccaaaaattatgccaattaaatccgaccttaaatgacaaggcttttctctcatgtttaaaatcccatttttttccccttgccataaataaataaaaataacttgtggcttacaggctgcttaataccacaacattttaatgagcatgtcaggtaacccacaggcttcagttctttgttgcttacaagttccatccgtaagtgtgagttgctcacttagtctggggtaacaaccgcagattcccacagagaagaatcagtgtcttaaaacaaggtaataccaacccaatggtctatgaataggttggaatggcggtactttaagtaaaagtataaagaaatggttaacattatgaggaacttccagcagtactaataatcaaccctgttgttcaggagacattcacttgctaaactttaaggctaggcatttactgccttgaaagcaaagcaaatgaagattttgaccaactgcaacattcaggctctaaaatagaaatatgaatgaattattaaataataggtaacatttactgagcacttacgattttccaggcatctgtgcattatctcatttaattcttacaactctatgaaggtttcattatattatcctcactttacagattaaaaaaaaggcttagatctgcaactggtagttttggaagaacattcttttccttaaacaggaaactctaaatgccctctgttttgtccacctttgtgccactgtctgcttctgtgagggtcaggataatagtatacctgaaaccgcccttttagcaagcggcagggccaggacataagctcagactagatgtctaattcacttgctatacatgtaacatgtaaaataaaaaagacctgcatcttgactggtgtactctttgataaatgggacctgattacttgatggaggcatgtttgactatctttgtttatgacattagcaaactttcaatgggtttggaagtgaggctatttagttctgtgtcttactctgcaatccagacacctgtgacttgaggtaaagtaagtgttttcttggtttcccaatcatgagagtgaccgaagaatgacattttccaggtcatcattctcttgtggatattgttctctgataacaatattgggcaatctcaaagagctgtcatttcttggcagtgaactacaggctatttggaaaggaggtgtaaatcactttttcatcatgtccagtcctctgcactctagagtcatttgggatgttttgtgtctgcactacctctagagaatgatggaaatctaattctctgtcagcttttctacctggctagtgaaaatgcttcttgggagagctgggaggggaagtcgctgtccatggtggtcgttactgaagccccattcagcaaaatcggttcatactctaaatactggaatcctgcttaattaaactaaggagcttctgcacagcaaaataataaacagagtaaacagacaaccttcagaatgggagaaaatatttgctagctatgcatctgaaaaaggactaatatccataatcgataaggaactccaatcaacaagaaaaaaaaaagcattaaaaaccgggcaaaggacatgagcagacatttctcaaacgaagacatacaagtggccaacaaacacatgaaaaatgctcaccattgctaatcatcagagaaatggaaattaacagcacaatgagatagtctcacaccagtcagaatgactattattaaaaagtcaaaaaataacagatgttggtgaggttgccgagaaaagggaatgcttatacacaattggtgggaatgtaaattagcacaacccctgtggaaaatagtatagggatttctcaaagagctataaacagaactaccattcgacccagcaatcccaatactgggtatctactcaaaggaaaataaattgttatatcaagaagacacctgcacttgtatgtttattgcagcactattcacagtagaaaagatatggaatcaacctgtgtctatcagtgaatgcttgggtaaagaaaatgtaaatatacaccatgggatactatgcagccataaaaaagaatgaaatcatgtcttttgcagcaacacggatggagcttgaagccattatcctaagtgaaataaaaccagaaaatcagtaccacatgttctcatttacaagtgggaactaaacaataggtacaaatggacatacagagggaaacagtagacactgggaactccaaaagcagggaggatgggaggggactgaaactgaaaaattacctattaggtataatgtccactctttgggggatgagtacactagaaacccaacctcaccgttatacaacatatccatgtaacaaacctgcatctataaaaataaaaataaaaaataaacagctgttaattttgcaaaataagtaaatattacagtctggaaattaacttcatcatggcactaatgaaatttggtgatattctccagtactgtatattaaaacataaagatcttatcagtataatctactggttggagtaaaaacattaaataattcacaggagaatgactttttactctatggcactaaaatagcccctattcattgtcaaattttagatatttttaggtaccagaacagcataaaggggataaatcatttcctgaaaccctctcaccttacagcaaagaaaatagctacctatagaggttaaccaccataattagaagcaggcgtaaaaccatgaattcttgccacagaatcacttatcatgattctgtgatgcaccaggatattgaatgtcagaatcattctttcttcagtaatttcatttttttgcttaaaaacaatttccaatttatgtcatttgaaaaacagataatatatagtctgatgtaatatgtagctcatgttcatttatgtggagtgtatctaaatcttataatattctagctgtattaagtaatattgtttcctgcaaagtgagacagtagaaaaaactcttatggtaccaatttctgaccactgtaacccagtgaaaagcaaagcattaatttcattacaggtcatcaagaatgcaaccgtcaacataaactgcttatttaagagcagccattttctatcagaaaggactaatattaaaattccccactttcctatattctccctttgtattaaaaaattatccaggggaccatgttgaatattccagtctcaaaaatccaaagatggtggtaatttttctaagagatatgtaaggccctttgtaagatttagaggaataggattttaagagtttattcatttgtttagtagtagtataatgcaatagttaatctcctgactttggaataagacctgtggattcaagtcatgggtatttaacttaattgttttgtgatcttgagtaagttacttttttgagccatgctgttctaatttgtgatatgaatgtgataataatgtaagctacttcacaagagttgtggttggaaataaattagattaccaatatgtagtacttttcactaagtaccacactacttttcactaagtaccacacattggtaatatcatttggccaggttaaagtttccatttactcaatcaaagactaatctaggtgtttctgtgaaggtattttgtagatgcaattaaagtctatagtcagttgactttaactaaaggagattatcttagataatgtcattcaactagttgaaagtccttaagagcggcttccctgaagaagaaattccacctgtggacggcagtttcggctcatccacaagagttttcacctgcccttcctaatggcttgccttagctcagtcttgtccagccagtctccacaatcatgtaagccaattccttgcaataaatctttttgtatatgtctcctactggttctgcttctctgactgaaccccaactaacacaccatgtaaagcattaactatagtatctgtgacataataaacactccaaaatattagttaattttttaaattaacccttattgaacatctctcacatttatagcactgaggtatacactctgataaaaatgtctgagagctctgaaatagaatagggatagatagatacttattgtctccaatgatagtaacctcaaccaggaagggatttaatgttttagtaaaatttccaggaaaacaagggaaaagtgccaatgggttgattattccatctggagctatgtaggggaattatgcaaattcagtatgaggccagtttcctgggttaggaagacaatgaacaaaaaggcagttactgttttctcaacagatccatatagatgtagcacctgaaactagacacaccagtttccatggatcaaccatggaattccattctgtaagaaaaatttatttacgacttggtcttaagccaattggaattatatacttgataactgccttgagattcttggaggaagaaatacgctcatatttaagagtattaaagtaaaagatctttcttatttcaatgttagcttatcttagtattctacattgttagatctttgaatttgttttgtgcatttttaagcaaggaaaaaatacttatatcactaaaaagcaggcatagcacaaacctacttaaatagaatctgcctccgtccttcagaattataatgccaaacttacaaaacttaaggctggaaatatctcagatgagtaaacaaacctcagggaggtagtctcagatataaataggattaaaaggtgatgagaaagtaagagagagtgagagcatgccttttggttttatattaaagctctgataatttagagtgaatcttagaaatagaaatgttttaaattgtgtgtttgcaggtgtgtatgtgtgtattcactaaagacagctgtcccatgatcctttatgccataatagtaattttctcaaaggcagtgctattgctgtaaaaatacttttactcattatgcaaagatttattgaatacctgtgatgtcatatgtcgagctggttgctaagggataggaaagtaaattagagatggactctaatcttgtggaactctctctgggcaactctaatttatccttatggatttcaactaacacgtgactttctctaggaaatttttgtacttcccttgctctgcactggcctaggcagttctcttttgctctcacagtaactttgcttccactaatattgcatttatcattttttttagtaattagtcaattgcttataaatctccctataagactgcatgaggtcaaggaccttgtttatgtgaacctctatttttgctcggctcttgtcctcaaataggcattaggtaaatatttacagaacgagtgaaagaaagcttgggacatgttgaattttaattgctttccaaatagaaatatgcaggaagcagaaaatatataaacctggagctgaggacagagatgggtgcaagggatacaaatttgtattagctgattcctggtagttggaaggcctgggtggattatcttcaatgaggctcacatgtagaattatgaacgagaaagtctgaggtcaggactctggacagcgtccacactctccattttatctgtgggatgaaacatggcccacatggctaggatggaaatgttttgggaaacccaaagcccaaataaatcttttcaaccatgtgagtaagtttctaatagatatttcagaactaagttactgtagagacaggagcactataaatatggatttataatcatgacattgtggaactttacctcccaatatgtagagagcagggttttcaatttcgcaaaataaataaatgaataaatgttagcatatgttaatagagggcacaaaatagaagtcagagagagaaagagtgtctgtggggactcaacagactctgtgggaatcagactctctgattttctctctcaatggaatcaaggagtcccacgagttaggcattgggaaaggctctctgggtggtgaacagacatgtgtggctattggtggtgaatgtccaccacagaagcagcgtggctcttccttatactcaaggcttttttttgccattaatgagaagtaagacacagactgactcccagcacttaccaattttattattcttattgcctcctcatactttgccatgggaaaatccctgtttggatcacaaatttaaaacaatagactgcctgttaaccatgggcatatttacagatctgactatgagctaatacaacccagagtgagcagaagggacttatactttttcctgaaggcaagcaggcttggaatccaaggggaatgaatataaacactgagacccatctgccccagtcttctgaattaaaacctagggacttcttttgttaactctgttcaaggcccaaaccacatacagctccattgagccacagctaagatttttgcttgcagcctttgcttagaactggcccctgagagtcagtttcatctgtacagcacagttggtaagtacctcatccttcccacacctttaagcaacagaacagccacagtcaacacttacagcaactttcaaggttagcaatgaaagaagaaggctgcagtaacctcatctggatgcctgttttactaagtaattatacatcccaaatttcacaggacaaccttctttaaatgaatcagatcataaaatctgatttttcacttaggaaaatatggttaaatcatattagagactcatacttggagtcttcaaggaggtagcataatatacagaaaaaaagtccatggactccgaccgtggttcaagttcagctctatcatatttactggttgtagaccctgagcaacttgcttaacctgactgcacctcagtttctgcatctgtaaaatgaggataagtgttctttaaagatgttgtttaaggattaaatataagtacactcatataaaaatctagcacaatgcctggaccacaataattattcaaccagagaatcaagttcaccctagtacaaattcataagcattcagaatcaagaagttattccagcttatcaacagaactaaataataaagctcattcccacagcaccttctagtgtgcttatcagctgtgtaagtgaggaggagcccatgaacttgggaggggacagtaactttttatattgtagactcataaaaatgattttatttttttctctacaggatttttagaggacaaaatagtctctcatttgatggtgattatgtacattattatgataattctctaggaatgcacattaaggattttgaaatatattagaaggacaaaggaagaaagaatgacataataaatattaaaacataatttggggttgggataattgaatcttaggataaaatatggctgatggccattgttttttcctgctcaacacccggtgctctatttctgttaccaatagtctgatttgttactggggacccaactctcccacacttagctatgaaatcctagataatcaaccttaaaagagctggccatggagtggacccatgagccactggccaagcagaagattccatcatgcagccacagtggtttgttcagagacggtcagaaccaagactgttggaactactgggaaaaaggggaactcttctcactggggcttctgatgatgagcttggtattaccagggtgccaggtgtaatgcctggagctgccaagggccatcttgtggagagggtctacccaagagtgaagccagcgcagagaaaagcagagcagagatatggattggagtccagtgatagtttttgaggctctggatccagtcatgcctgaaacctttggactttatctcttatatgagccaataaatttttcattttacttcagccacttggagttggatttttggcagttgtaactgtaaagtgtcctgatttcttcagcagggaacttaagtataatttatctcaacctcccctctgatgtttgaatcttctctacaacttctaatgaaagagtcactcaatcaaggcttggactcctccagtgatagggagctcattaccaactgaagaagcccatccatctttgagacttatattactgcaaaattttttcttatatcaagtgaaggtttctgaaacctttgtaattaccacttattttgtacccagtagaggccagagaccctgtgctatgttatacttaaaaatatacattgtgatttaattctcaaattaaaaatttgaaaattttatttttgaaataatttaataaattaaattaataaaaattaatatctaatgatattaaaattattttagaagctgctgcacaaatccaagtgagaaatgatgagaggctgaagcaagggctatgggggtggggataaagaagatgaggagggatccagtgatgtacagatgtagcatacaggtgactgagtggagggtgagggcaagagtgaaacaggagacttggagggcctccagaaaatagacaggtgttgaaaagcagggagaaacaacctggatgggaaagatgaaggttctgctgtttatcccaagagttaccataagtcgaaggggtcactacttccaaggacacatgatagctctacaaatttctttaaaattttaactgaatctggtttagtgttaagaaataatcatgaacagaattggatgtgcatcaaaagcaaagttttagaaagacctgcaatttttgcacagacctttaatcacatgagtgcaagtcagaataacacttttatgttcagcccttaagactggtttctcccttctctcctcctgccagtgccccagaaggcagaggagaggatccagagaactcagcacgaagatgcagcagagtttgcctgagccacaggggatgggagtctgaccgtgaggtccaggaaccaaagagaagtgcattccagtggaatatgtttctaggaatgggaaagagggagaaagggaagaaacattttatgtatacctactatgtgccaggtcctttttatgtaggattattattattatttcagtatcactttttttttttcccaaatgtaaaaactgtggaggtctgcaaagttaagtaattttccaagatcaagcagcattagaattaagtccaggatgtatgtatgcctctgagatctgtaatttcttcattatgctatgctgtctccttaaataattagcagttataagacgcaagttataaggtgacaaaatacattgacatggtatctggattaacaacaacccagaaggctagtatttctaatattgtttctattttatagatgaggaaactgagtccctaagaggttcattgactagctcaaggccacacagctagtaagtagaaccatagctggaactaaaaattcccatctccaagatctgtgtattttcccatgacactgcagctactacgctgggcaagctactatgaagctggactttgtcagaacagtgacagataacagctttgctctgaaacgttctttccttcaaaggaacgcacccaacctaatgcttgtggtggcgcctgctttcacccacattggctcacaagagaaagactccaaggaaaaaaggaatgagggtccctagagtttctgatgagggtagggcggaggtgctttcaaggatggttaaccctctctcagggctgggcgcaaaggctcctgcctgtgatcccagcactttgcggggccgaggtgggaggactgcttgagttcaggagtttgagaccatcctggacaacatagcgagaccccatatctacaaaaaatttttaaaaattagcctggcatggtggtgcacacctgtagtcccagctgtccgggagggtgaggcaagaggatcacttgcgcccaggaagttgaggctgtagtgagccaagatcgtaccattgcactccagcctgggtgacaaagcaagaacctgtctcaaaaaaagagaagaaaaagaaaaaagacatgagacgtaggagccaggcatttttcagccacaaataccaagtggataaaaaaaaataatgaaaagaatagaagaatggttagcccactctctttctagtgaaccctgggataaggtctatggtgcagtgctgtgaaaattcactcaatccacgagatctatacactttgttgggacctgggatagaatgaaccagtgttcccttagaatggaaatgactgagtagaaataatgtgggaagccacattaactctttcaggccattaggctatcatttagtaaattactacattgttctaaatgggtccctagtgggtatggagggtgagaatgttctaatttgcttttctctcctttctctcagctgctttctcctactatgatgtagaacaagaagtggtttaataactgctctattccaaatcactgaatgctcttataactactgcataaaagtgcccctgcaggtctgctatattgaaatgtgtggaatcaaatctatgcatatgatatgaggggtgggggctgcaatctggtacccacaggatctagaagtaactcgaggaaccaggatatccctgattttaaattctaggttaatggagggcgtgtgaccgagagccccatgttcctggggagggaacagatgccactggaagctgcagggcaggagtttctccacctaaaagggaggatccacaactctgatctgaggaggagtccgtgtctctgccttggcatgtatattacaagagaaaatcataggaagggcaaggatgttccctgacgactggcttccctctgtcactcaggatgcatggccactgttggttgaaggaactatcatttttctccctgattgaaaaacaaaagaatcaaagctctcccttgtgcttacaaatctggggatattaattaaatacctagtagagatgctggggcctaatattattgcataatggtgattacagcaacaatgcattatatagcattaaatgtttttgaagcactttcatattcatttgttttttaaataatttttgtttttatttttttccagtttcattgaggtagaattaacaagcaaaacatgtacacctgtatgtattcaaggtgtatgatatgttgttttgacatacatacacactgtgaaatgatttccacaatcaagctaatgaacatatcatcccctcacatagttactctgtgtgtgtgtgtgtgtgtgtgtgtgtgtgtgtgtgtgtgtgtatgtatggtgagaatacttaagatctgctctcttagtgaatttcaagtatacaatacattattattaactatagttaccatgctatattattaggtctcctgaacttattcataactgcaagtttgtaccctttgtccaacatctcccctttgcatattcgttgttggtcagggctatcttgatggacatatgaagatgggctccatgcttggtttaattctctgcagtcacagtcttgtaattccaaataactttaacttggaattagtattttgtaagcaaggtctgatgggactgtggagcatgtgctgggcttggaacctcagcttgatgccgtcctgccttcctgggatgggtttttggctgccagctccctgtctcatgctggtcctgctcagggccctgcccactccacccccttaccccacaaccactgctgcaatcaggtggcactggcagggggaggaaagagaccagcttggattcagtccttgaccactctcttcccccaatggtggtggtgggggagtctcgacatggacggtcatccacctcatggctttttggggtaggcaaggcagcagccatccttgtccctaattgcaacatcatggcttgtttggtgggtgatatagtttggctatgtccccacccaaatctcatcttgaattgtagctcccataattcccacgtgctgtgggagggacccagtgggagataattgaaccaaactgtttaccccatactgttcttatgctagtgaatcagtctcacaagatctgatgattttataaggggtttccacttttgcttggctctcattctttctcttgcctgctgccatgtaagatgtgcctttgcttctcctttgccttctgccaggattgtgaggcctccccagccacatggaactgtgagtccattaaacctctttttctttataaattacccggtctcaggtatgtctttattagcagtgtgagaacagactgatacagggggcaatacagttggtgactctgcatgagtctttcacccatctctgactcaagtaccaagcacatcctggcctagggattgtaatctgttgggtagtcacctgtctgctgtgggttgggagtggtgggcctgtaggaaagggagattgacttccctgtccctggccaggcctcacagtttcattttataccaggccttgcaaaatatatagccagacctgtagttgacatttattgtaatatccatgcaagctggataggacaagaatgttgctactgttatgtctgcttccattatttctactgctggggaggctaccattaccttctctgtgacttgcacttgggcaagcacttaacaatatatcatcccatttaatcttcacaaccaatatacaaggtagggtttatacactggggtggttccctaacttctctgagttttagtttcctcatctggaaaactggtatcataatgcctacttggtaaggatattgtgagaattaaataagatgacatgtatattaagagatggaggtaattttatctacctgcattcctctaattctatatttgttaggaagaaatcttttggtaagctgcttgaggagaagagtcaccatggacagactaaaataacccaataagcttgcttaacttttgcacttatgacaaggagtagtgtttgttccttgccattgttcccaagaggaaggtggcaaagaaagagttggtgagggcgaagcatttgcaggggaagagaacaggagtgacagtatgtcctttagaaagtggaaatattgaatggggttctaaacaaattgtttggttgggtttatgctataaacagcccaacctacccaccgtcatgaaatcttcagtaaaggctgtgtagctgactaacgcttttgtgtgtgattagataaatgcgggagaggggctcagtgtctgttctcaaagaggcattgaaattcacatccacgttggcacaagtgaaaacagacagcttgtgccagaagatgagtgcagagctggtgtgtggttctaatactattcttggaatgcttcctctgagtgacctccctctctgttcaggccacgcatttctggagggtataacagcagtatattgttatattgtatatatatgtatattctgtttggtttctattcttccacaggccccaccatcaggttccgcacagagtgaacactcaaatgttgagggctgataaatgtgagtagcaactactaaatgaaggagatgaatatgcttttgtatagtaacttcaacgatgctttgatatagaaattagtttacctagtgtactgatgaggtacatgaggctcagagaggctaagaaacttgcctggcgtcacacagctagtaagcagcaaaaacagacattcatgttccatacacaatgccttcctggtcagtgacactttagcagactatctagagttctggcatcgtataaaccaggcattatccacatatgtatattttaaaacctcactgaaagcagaaggataagatgaattgactttaagcattcctggggaacaaaaagtcaaaatggaaaaggagaacaggagcataagaaaaaaatatatagcataactcgttatcccttagataactgtagggtcatgctgatattagtcattgtactgtgatgacaccaaaaagggaaagtgtaccagctagccaggtagatgcaattcattgtgcaagaaaaggctgcctcaaatgtgtctaaaagcgtggttcttcattcagccaagtcaagaccaaaggagcacatgaataattggctacagctcccctttcagcaagtaccagctttctctgctgaggctgatacagctccatacctcagggggccgggaatcagctgccagcagccaatgggcttctgagcattcataagcagaccaggtgctgatccatcaggctaattagcagcctgtgggccacagttagctgggaaggtggagggttttaactcttttcctgacagactccaagcctatctgggctttttgagcaatgttctatcagtcaaaccacaaagaaaagtattagaattcaaaaggagggaagctaaaaggaaatatagttttgctttaaataagacaagggagactaacaacacaaaggaagtgaactttgactctcaaatatacatatatatagatgtatatatgtgtctgtacgcatctcagtctacgtatcttcatgttactgactgtaatgtcatcaccacagcagacattcaatacatgtttgcttttgttgaggatgatatagtgatatttaaaacagaaataataaacaagggaagaaaataggacaggattgcaagggagggggatatttagcttgttggcacctgaaatgtatttaattatcaggctcccaaaagagcagaggaaacagaattagcttcaatgaaaaatacagagaacatgctgaaagttcagaaaaaatgcaaaacttactttaattaggagatggagatggaatacatcagaaatagtgtcactgcaaattaccagacttataaaccaatatgtaaatcagcagaggaaacaatcccatgaattttagtaaatttgtagaaacttgttgtaaatagtgcatttaaaattagttttaatgtgaaatagaatcaacaatcaatgaagccaacaccatccaaatgtcttcattgacataaaaggagcattctatagtcaattggttctatatttttgactttagtgtggttttgttgatcatggatccaataatctccagtgaagcagtgccaatatatgatctagcgataggaaataacaaacaagcatcctaatccttaaagtagccaaatctgacaatcatagaaaatggcaaggcaggatactggcaaaagtcttaaaacacagaggtaacatttatggagatgtctgcacgggctctctgtcaacatatggagaattgaggaagagctacgggatttcaatgacaagcccatcaccaccatctggagataaaaattctgtggtagattttttttttaaactgtgatattttactgataaattttatattagtgacaagatcctaaccaaagtttccttggactgcttactataaaactgtgtactattgactctggggttaaaaaaatggatttatgcctcactgagaaacagctgtcattgcatttgtagaatcatagtgtcaagatgatgaaactgagctaattccagagtcttcagggacctaaagaaagcattatacagccctgaggaggtttgggtgtactggcagtaatgtcaactgtatggccctgagaaactaatctccatgttgagattatgaacacaaatctttccccaaatatttactgagtaaaaacatagtgagtggtccattagggagagcaggagcatgagttggattgtttttgttctaagaaatgaatgcactaccttggactataatcaatttggggattgtggtcttttaaacagaccatagcagatgattcagtgtcagtgggccactggattcatgccaagtgataattctccataacgcttcctacagtctggtgtgtgcaaaacaggcaaggtcacaagtctgttctacagccaccgggtgtgctggtccttttattgtcctggcaaagtaacaaccctgtgtatgcacccctacaaactatctccccatggtttggtcagagctgacccccaagctcaccctgcctaagtcatttattactagcagaggaagaaataagcatataatcatgaccttatctacttctctagcctcaaatctagtctctcctcaatcaaaccctttcctatccctcagggacaccttgactgggtgcctttgcctgtgggactctctgcccttagcatctttcaattagttctctgcctggaaggctgttcttctttcatgtgttacctcctcctgaaatggtttcttgataataacagcaaacacataggatttgcttcataccaggcgcacttctaaatgctttattaaatgtacttacttctcaccagaaccctttgaaataggtactgttatagtctctactttagatataaagaaacttaaaggcagagttgttaagaaatttactcagggtcactggtaaatggtagagctgaggttatgaaccatggcagcctggctccagagtgtctgttcttcatcacgactctgagcataatgatccctagactttgctgttagtatcctgagcactcgctaccagagaagtagctgcactgcactctagtcatgtttgtaagcttcctctctttccatgctaactccagttaatccaacaacactcagccaaagcatcaactttttcccccttaagtcttcctgatcctgctcccctaacctgtgggaggtgaatcctccactgcccacaccatgcttctctctgctagactccttatcacaccacgtgtcttgtttacctgtctgcctccctcattaatctgtgaactctgaagttttgaaggcacgaatggtctcagtaacacagtatctggcatatagaactgttgcttaataaatatttgtctgtttgatggatggagactggtgctaacaagtcttcattttgcaactctggtttctagcttttaccggcagattaagaacaaaagggattccatcacaaatcctgggagaatcatgacaaatgcttagcttcagttcagaaagaagcaagactatttatagctcagggactcaacattaaatgacccggacttaatttttccttgtgacctagatttgcacaactttagatggaaagtgcccttggagatcattttacccaggtattgcaaactggtggcctagagttgtttttatttgacatatattatttgtttctatttttattagaatacctttagacaggacatgtgctttttatttctccacattttacatcatatcctatcatacaccactttactcatttgtattatccacctgaccattcaaagcatttgaatatgaaatgtctgaattagtctaactcattttttttggtctttgtttacagtaaagctcccaagtctgtacttagggtctccaattttctcattaattcattccagtcagatgttctcccaccctctactgatgtgtagactgatttccatgtaacaatgtaccaatcatgtaccagtgatttccacctagctaaatccagttcctagcttggacctcaacccctcctccttgacattcaggaccatactctcctggttttcctcctacttctctggcctccccttctctgtcttcttgctgattcctcctcatactctcgacctctaaatgttggatcctccaaggtgcagctcgtggcctgcttctcttctggatctactctcatccccttggggatcttgtacaggctcatgagtttaaacactgcccacatgttgacacttcctcagtgtacatctccagctcacttggttgtctagtgggcctgtcaaacttaatatgtctaaaaacaaactgccaatttcttcatattttttttgttgttgttgagatggagtcttgctctgttgcccaggctggagtgcagtggtgcaatctcagctcactacaacttccacctcctgggttaaagtgattctcctgcctcagcctcccgagtagctacgatgacagacgcgtgccactaccacacccatctaatttttgtatttttagtagagacaaggttttgccatgttggccaggctggtcttgaactcttgacctcaggtgatttgcccgccttggcctcccacaaactgtcaatttctaccccaaacctgctcttcttagcagttttctttatgtcagttaggggtatatccgggccaccagttgctcaggccaaaatccatgggcttatctctcattgcttcctttctatgtgatatggtttggatatttttcctcttcaaatatcacgctgaattgtaatccccggtgttggaggtggaatctggtgggaggtgtttggatcatggcggcggatcccttatagacggcttagctctatcctcttggtgatgagtgagccatgagatctggttgattaaaagtatggtacctccccactctctcttgatcctattactatgtgacatgctggctccttgtcaccttttcagccatgattgtaagcttcctgaggcctcaggagaagcacatgccagcaccattcttcctataaagcctgctgaaccatgagccagacaaacctcttttctttataaattacccagcctcaggcatttctttatagcaacacaagaacagtctaacacactttcatatgccatatacaagtcctcagcagtcatgtctactccaatcttccagtgcctcccttgttctttaagagtaaaagccaaagaaagtccttagagtggtctctaggagccttgatattctaccttccttccttattcctatccctacctttatttctcagacccccattcccaccactatcccccttattgacctgcctccagctcactggcctcccttcactgttgagtgaacactccaggcatttttctacatcggggtgtttgcatttgctgttccttctgcctggaatacccccacccttcccttccccatccccaggtatctgcatgtatctgcatgggttgcttcctcatttccttcatgactactcaaatgaacctcctcactgaagctttccttgaccactctatttgaaatagacttccctaagccaggatgatttttcatccctcctttctgcttttctctagagcactttattaccctctaatatcctatatattttacttacctattttgtttctcttcctactagaatgtaagctaaatgagggcaggcttgtttgtcttctttgtttactgctacatcctcagcatcagaataaggctgagaacttgttatgggttgaattatgttccccccaccacccccagtaagtcccagtgaccttatttgggaacgaggtcattacagatgtaattagttaagatgaggtcacactggagcaggctggacccctaatccaatatgactagcgtccttctagaaagaatggcatgtgaagagaaggagatatccatagagggaagatgatgtgaagatgtacagggagaagatggccatctacaagccaaggagagagatctggagcagatctttcagacttgatttcagacttctaagacttctagcctccagaactgtgagacagaatttttttttagacagagtctcactctgttgcccaggcaggagtacagtggtgtgatctcagcttactgcaacctccgcctcccaggttcaagcgatcctcctgcctcagtgccctgagtagctgggactacaggcatgtatcatcacacccagctaattttttgcatatttagtagggacgggctttcaccatgctggccaggctgatctcgaactcctgatctcaagtgatccacctgccttggcctctcatagtgctgggattacaggcatgagccatcgtgcctggccaagacaatacatttctattgtttggaccaacctgggtgtgttactttatcactacagccctagcaaactaatactcaaaaaaattctcaagaaaaatgtatgggtgaataaacaagtgaattaatcctttcaatgaagaaactgaaggccagtgaagttgattaacttgccagaaacacaccatggtgaacgggcagaaccaagactcaaatccagctttcctgccgccccatctagctctcagccaccacatctggatgccacgtcagtctgtctcatgagcactaacaatggtgggctgaggttgagggggatctccggagccccttcaccatctcctaggtcttgcctatcctgccttcctgcttaacgctcccaccaccatcacataacctggatatgttgtggccagacaattattgacgtatgtttgttaagtgttctgatctcctctcagaggaaaaccctgtgtttgactcttctattattcaggaagtaataaaagttatagtcataatatataagaaaaaagaatgattcactgctgagctactgagctacagggagcaatccaaggtttagaacagacaattggctaagatcagtcacgatgatgtcacagcggaatatacaaatacctcagtgggctgatccaagagaacatcacaattaaatcagcttactgctgagcactcttccacatctgtgaagagctgctctccattctgacagccacgtttaaggaggtggtggaggcggcagtctatccaacaccctccacacaggaagaaaggattgcaaagtgctactgagtaaatgaacatcattcacatggaaatgcactggacgagatcatacatgttaagacagttaacagacaggttaggaacaatgttttcttttcagaatggaattacagtatgacattgggcatgggaaactgatgagagccatcagagatgatattcaaaatgtttaacaaaatatcgacagcataagccatcaatggccaatgcagccttatcaatgcagagtggttgaacatggtgctggtgaaactcacttggctagaatagcagagatgccattaacctctctgacccttagtttagtttcttcattgcagagtgaggcaccaccacttatttcctagtgttgttacaaaggttaagaaaaaaatctgtgccacaattcctggtacatatcagatccccaataataagagcaaacatttatgtgtctttattatatataaggtattagcaaatgctaatttacttaacccttatagcagccctagtattcaactattttttttttttttttgagacaggatctcactctgtcaccctggctggagtgcagtggcacaatcacagctcactgcagcctccacctcccgggctcaagtggtcctcctgtctcagcttcctaagtagctggtgctacagatgtataccaccatgcccagttaatttttaaatttttcgtagagacagggtctcactatgccacccaggctggtcaagaactcctgggctcaagcaattattattagcattttcccgttggagaaattgatatagagagcggttaagcaactttctcaatgtcacactgctggtgaatggcaagacagggtcttaggacccaggtagaatgaatcccaggggctccttccccaccctatgctaccctcaggaaatgtcggggcccatccctcccactttatgctccagagagccagtgtccctgcaaacctaacatctcattgcctcaaagtcccagctaaagcctagtggagaggacatcactctttggtccttcagtgccctagcccttctttctaggtttactcaatttccatttgcatgaagacagacaagaaaaacagtccaattaatacgaagcgtaagaccacaagatgagaaggcttttgctttgctttttattttgtatcagctgaagtgctgtgagtattcgggatgaaaaattatttatcccagttaatgaatctcatgataataaaaatgcctgacagctctgagattagtgagtagcccttatctggggaccacttagtgaagcaaatcctgcgtgaacaaaggacaaatgggatttgggagaatgaggaggaagggaggctaagaacgaacatgtgttttgcagctatctcatgccaggcatcacacaaggtactcaaccctcattctttcttttaattcttttgagaactcagtctttatacaaacacttatggcagtgccaggtaccataataagtgttggggttacaaaattaaataaatcatggcccctgtccttttaagtagaatggatacagaaaataagtagagaggctatttatgttcactgcaatattagtttgatatgagtatacacaggcagtggaactatgctatacaggccaagatgatacctaccatgtcaatagttcctgcataaggactatttcctgcatacgcagctgtgttctgggctgggtgatatacccctgcacctccccatggcccctcaggcccttcacggaggttagttggctagaggagtgagattctcttaggagtttacacttggaagcagaaagagaatcaggcaattggttgtgggaacagaaactgagaagatgatctaaaaggagtgatgaagtacagtagaatggggctgggtgggaccatgtgtaagcggaagctatgaatacacagaagatacaaggcacagaaaacgctgagcagaatgtgaggaagctaggtcgtagcaggaaatgaatagaagcagaggatactctaaccaacgtatgccccacaatttaatcctttccctaatgttagatcattctcattttttcctgtattacaaggaatcctatgatgaatatcattgcacatcagtatttgtagcatttctgatgagtttctctaatatattcttggattaaatggtatgcacattttaatgctcttgagacaagtatgcatctttatttccaggaagatagcactaatttcccacgcccttcagtattatatgagtgagtctactttaacacattgtctcacactgagtccttgtcacttaaacagggaacggtagtaactacctttttaattgtttaattatttaatttttaattgtttgcatatttttcatatgttatgggacatttgtatttcctcttttgtgactccagcttgtttatgtctttttgtccatttgcctataaggccatttataatgctcttattgatgtatgagaaatcaataaaatttatataacaagaccaatactcactgacatatttagcaaacacttacccataattagttgttttccttttcatttttatttgaggcacggaagttttatatttttcaatatattgatattttcctttgtaatttgtttcaaagggtttctttttgcggaaaaaaatctttttctgttttctagatcaggaaaatacttggctctgtttcttttcctacttttggaaaatgtttttgcttttatatttaacttttctgttcacttacaatttattttggtgtatttgaacctttatgaaggaagattttgtactaaattaaaaaagaggatggtgtgatcctgtttcagaaaaatctaatctgtgttaatgtttgttccccagcagaatcaaccatggattacttccaatgaccagtgcaatgacttgagcacacacagacccatttaaatacataatgagggagaacatatgatcaagggcggagatgccatcatttgtgctctgtatacaacctacttttattaaatggaaattatggtcactgaataactcaatctacctaaactcttacaaggaatcagaagccctcagttcttaagctgggtctgtactgatttacaatgggacacaaacacactgtacctccttaaccctaacacccactttccaattgcctgtctttcaaaactatctaattagatttctttaaaaagaacatttttgtcatttgtgaggaatttttcttttcttttttagtttgctcttactgaaaaaccaaggcaacttcaactttatcttttcatagggtccctttccaagtgttatgactgaatggaagctgtgtggttggtgaagtacttcggctatatttccaaaaatatgcaattgttaggggctgcaatgcaacagccagttccagagactagcaaaaggcagggggatactctcaagagtgactacactcgagactttccatttcagcaacttcaggaattggggaaaactcactaattcaacactgagttctctgaaagtgatggtgtattagtttgctaggtctaccataacaaagtacagcaaattgggtggcttaaacaacagacatttgttttctcagaactctggaggccagatattcaagatggcagcactggggagaaaatctagcttctggtggtttgcaggcaatctttgacatttctttgcttgcagaaacatgaccacaatatctgtcttactcttcacatggcattctctgtaaagccacactatttgcttagattgtttgaagaaggcactttcagatgtgttccagaggctgggcaccttgatctggatcaaacgctgccaattgttggttgaaggtgagtgtagaaatgtatctacttccaaagccaaaatattactgtattagtccgttttcatgctgctgataaagacatacctgagactgggtaatttatacaggaaaaagggtttaacggacttacagttccacgtggctgggaggcctcacaatcatggtggaaggaaaggaggagcaagtcacatcttatgtggatagcagcaggcaaagagagagcttgtgcaggaaaactccaccttataaagccatcagatcttgtgacatttattcactatcacgagaacagcacgggaaggacctgcacccatgattcagttacctcccacctggtccctcccacaacatgtgggaattcaagatgagatttgggtggggacacagccaaaccatatcaattactaagtacacagaaaaatttataagtcttggtccatgtacctcatcaacttcttctagcaagaagcagctggctgacttgcaatgaaatctccttagagttttatctttaaatcattgatctcaatggatatcttatacctgaaaatttgctgttttactaagggtgaagtaaattaaattccacaagagttagaaaataatttaatcagctggcaaaagctaaggatgaaagcaagttaatacaaatttcaattttcaaacaagattcaatacatgtatataatttatttggctagattcaatacatgtatataatttatttggctattacagggagagaaaacataattactaggtcttattaaaagtatgtctttcttcttttccctgtcatcctttcttccctttcttctttcatttttaaattcccttcccctcttcctcattccttcctcctttcttttcttcttccctcccttgatgttttccatttactcagaaaacatttagggagcaattaccacaagttagagtatacaccatatgccaaggatgcacccaaaatgtacaggtgataaagcagcagttcctgccctcagcaagttcatagcctaatagaatctgagttatgtaagggtgaaggccctacagtacattctctataatattgtagtaagaggaataatctcagatctcatgcatgcattccatgatttttctctttacttttgccactgtttttctacctgatattaatcttaatactataatcttatactactccttcaagcagctccgtgtgttttctataggcccaccaattattgccatgttctaataaggttttaaagaaaatatgtgaccctttagaacatcaccccacttccatgcctgtcttccatcctctgtataaagagcagagggtgtgaagaatggactagaagggttcctgggtggctcattgttgtgatctgtttgcctgctttggcatgctttgattataataaatatcttctctgaggggagcattttgaggaaagtgattgtaaaagaagatggaaatccatctataaagatggtaaccacaggaactaatttgaagaggtttttcatatttattaatagcatagaattgtccttccagaaagcataaagttctaaatttgaacaaagtccacagtctgaaccaaaattctgtacctttcagaatggatcataaaagaaaaaaagtctacagcacaaaaatagtttcctcctataacctcaaacaaatgtgagggcgatctgcccttgcaattttcattacttcaagataacaacaaggaaactatgattcagttagttctttcctttcacacattcagagttactctgcaattgctgagtgctagtgtatctatcctcaagtggcatttctgtttgagaactgtatttttcattatttagagttttctgtaatttttactggtaatattaatatttaacaatatcatacccccagaggtatctttgtgcaactttagaatatacgtactttgtttctttttatgactctaaccttttattctttcattcctctagtactctgaatataagagagtctacacgctttttagtgaggattttttgatccctgcttcataagtgtcactcattgtaggctttcctttgacaacaaaaattcctgctctctttacgttgactctaattacttcaccagaaaaggtaaacctgtcattgtgtaagaaaaggaattaagttaatgtaactgtttcttaaggtcttattattattttatttttatttttttgagacagagtcttgctgtgtggcccaggctggagtgcagtggcacaatctcggctcactgcaacctctgcctcctgggttcaagcgattctcctgcctcagcctcccgagtagctggaattataggcatgcaccaccacgcctggctaatttttctatttttagtagagatggggtttcaccatgttggccaggctggtcttgaactcccgacctcaggcgatccacccacctcagcctcccaaagtgctgggatgacaggcatgagccactgtgcctggctcttaagggcttaatgtgaatgttgcatacacatgtaatttctgattcatttgtggacctttgcgtaaaaataaaattttcttagaaattcatagaaaaacatggcagttcttaccatgcatcacagtcaatttcctgagggttctgttctttggagtctggggaggggaggtgctgtggtttggatgtgtttttttcccaccaaagcccatggtgaaattcaatcctcagtgtggcagtgtggggagatagggcctagtgagaggtgtctgggtcatagaggtatatccctcatgaatagattaatgccttcctgctagggtgagtgagttctagctctcaggggaatgggttagttcccttgaaagtgagaatgggttgttaaaaggagtctggcttccttggttttgctcttttgcttcctttctcagcctgtgatctctgcacactttggctctctgtcactttccaccatcagtagaagcagcatgaggccctcaccagacacagctgcctaagcttggggtttccaggatcatgagccaaataaacctcttttctttataaactacccgtctcaggtagtctgttctagcaacataaaacagactaagacagaggtcttcaataccaaaagatagtctacttgatgtgtgaagggaggctttggtttgcctgctataaaataattttagttgatgaacccgaagttccctgaaggtttagtttctggtgactttcattctgcaattcttgcacaaatggaaaaaaatccatcctagttgaatggagtacctacactacaaatgtagagtgaatctgtagaaaccactttttagataactgataaaccagctagttgctaatcacttcattgctgcttcccaccaccagtcaatgtttaaaaaaaataaagaattctccacctaactttgacaactggggaaaggtaggactttgtttcagcatcaaaaggaagtagagccacgtagaattatcatttagttccctcagtcatagccatttctcatttttcatcttccctacttttctcagggccatttattgtcctctaatgcctcccttctcttcattcttttttgctcttaatatctctggagggacaccaaagaagtgatttctttctgcattcattaaaaataggtttatgttttgccttcctgttcaattcccacttgggctgtaagcaagtaactaaagcaagggaagggttgggcatgtgggcgccagacttagatgcctctatttatgcctagattcttcctatttctcccattcttccctcaggataggagaaaaaggaggtggcagaggtctgattaaagcagggatgagcaactgagccaccactgcagtgctgagattgggtgaagcccccagcttcacagaaaggcctgcaacatcattgcaagattaaatgtgccaatattcttgctaagttactactttttgcacattaccagagaatagacttcccgggcctaaaggaatggcaatgttttcattgtcatttatttctctgttcagtaaggtagatagtacaggttttaagagtcttcttttttttcctcatgagactctatttcttttcccctctattttcttctatgctaaatggctgtatctactcttgaaaatacattctaactctaagtgtcctttgtggatttgactttaggaaaccaaagtagcttcccccaagccaccctctgtctctcttttttgtttttttgcccattggtcgattttaccttctttttgtataccatcaacccaaagacacagcatactagggacgtaagtgtggaactgataccgttagttttatttcggggtgatgcaatccctctgctaattcttagatggtcttatggtgtcagaagaaaatttccttctgtcagaaagccttaagtacgtttggaaaataattcagaatcaaggctgtcttcttctgttttttaatcaattcactaaatagtcttcatcatacagagaaattattccttctactccactccaaactaagacattattttgaaatagattatcaaataatagtgcagactaatttccatagctcaatgagtagaaggcaaagtacattatttgctaatgcaaatgctgagccttctccaaaaaatttaatattcaaagtccagacgggataaggagacaaaaaaagattgcttaacaattttccaaaccaaagtgacctataacacacaaaatatggttctattatgtgcaactgatattttctttgttgagaataatgagctacagcagaatggcataatgtagaactccacagctgataagctttctgcataagaacaggaagaggacatttcttaaagagttctgtgttcattgcttaccttgaggaggcagtgaatggaattactgttaatagtaacaatatgaagctaattggtttaaaatgaagcagcaggaaatgctgatgatgagactggggtatatgaaggaagaatgaaaaatctatactccggctacacaaaaatgatgcttaaaatgtaacttaatcttgatattttattcataaatgacaaatctgctcactacactgattccctaggtgactcatcaaatcccatctctaggtttatgaatctcaaaattttgtagctagttctgactgttttcactggcaaaatttgtcaaaatcaacttcttaagaatttggaaattaacccaaagtttgcaataatacaaaaagcatttacttttttaaaaaatggctgaatcccagtaaaaacagtgagctttgtggcattttaacttgcacttataaccatctgcctctccacagcttcacagtatccttgaaaatcaacagctttgcagccatgatagctatgaaaactagcagcctagcagccactggaggggacaggtcaggtatgaagctcccccaaaattcccattcccagagaatggtcactatttaacctgtctgaaagttccttaagaaagctccattcttatagtttgtctttatttgccttgacttaaagctcatttggtgggaatagccctgaccccagctaattttttgaaataatcagcaaaaaagctttcagaatagtgacactaattgaaactaaaaaaagaatgaccaaaaatttcacaggaaagactggataatgagatgtgtttaggggggtttgaaaagctctgatagatttctggtaatctagaaggccatgcacatatacagggctgtgcacgttcccagaaaagacctgagaagcccctattctctcatctctagttgactttgaggttctgtgcaagctggatgtgaaggctaaggcagagttgtaaactgcctggtagagcattgaagacacaccttaatacacacacatagtcctttggcagtggctgggagacttactggctcaaggcatttaaggaaatctgttcaatcattaggtaattggtaagctaactgagcacagacttctgtggatgcagtgagagataacacagaatttacagaattagtccaggaaagtcactaaacaaacagcagctgcaataataaagggcatcaacaacagaccttagagaggagggaggaatatgaattccagaattgccacactatattccttaaaatgtatagcattcaacaagaagttaggagacatgtaaataaaaagcaaagtatggcccatacacaggaaaaaaggaagtcaatagaaactgtccatggatgttggacttcctagacgaagactttaaaccatctatcataaatatgttcaagttactataggagacatgtctaaagaattaagggaaagtatgaaaataacgttttggcaaatagagaatgttaacaaaggatataaatgatttaaacgtacaaaatcggaattgtggagctgagcagtgtaatagctgtgataaaaatatagtggggctcaacagaagaaagaataagcaaacttgaataaaggccaattgagatgaataaatagaagaacagaggaaaaaagaatgaagaaaaacagtatcaaagacctgtgcagtgccatcaaatgtaacaacacatgcatagtgagagtcccagacagataagagaaaaaaaggggatgaagaatatttgaagaaataacagctgggaactctccaaacttgatgaaaactattaatccacacatgcaagaagcccagtgaactccaagtagggcaaactcaaagagatccttactttactacattacagccaaactttctacagctaaagacaaaaagagaatcttgagaatgccaagagaaaagtgactcattgagttcaagggatcctaaataacattaacagccagcttctcaacaaaaaccatgaaatccagaagaaaaaggaatgacctattcaaagtgccaagaattttacatccagcaaaaccaccagttaaaaacaaaggagaaattaagacatcctcagataaactgagggaatcttatcactagcagatcttgctccacagcagatagtaaggggaaaccttccgggggaaatgaaaggatgctggacagtaactcaaatccacatgaaaaaataaagagtaccagtacaagtaactgcatttgtaaatataaaagacaatataaacacatttttgcttgtaactctttctaatttaaaagacgaatgcaaagcaatgatgacaagctgtttgataggcttataatttataaatatatacttttttaattgaaatttttttcttttatcatccagcccaaaatgtcataaagatataatttctatgacaataataacacaaaggaggagaaagggaatgaagctatattgaagcagttttacatataattgacggtaaattggtattaatccaaactagattattttaagttaagatgttaattgtaatctctaaggcaaccactaagaaaataaagatatagtaagagaaacaagaaaattaaaatagtatactagaaaatttatatgttaaaaagaagaaaacctcaagtcaataactaaaacacacctcaaggcactggaaaaagaagagcaaattaaacctaaagcaagaagaagaaaggaaataataaaaataagagtagaaataaataatttagagaacagtaaaacaatagaggaaatcaacaaaaccaaaagtgtattctttgaaaagatcaagaaagttaaattaacaaatctttacctagactgaccaagaaaaaaaaaagactcgaatttcaaattattaaaattaggactgtaagaggggatattggctgtgcagaaataaaacaaaagattataagggaatgccatgaacaactgtatgccaacaaattaaataatcttggtgaactgaacaaatacctaaaaaaccacaaactgttgaaaccaactcaagaaaaattcaaaaatcttaatataacaaggatagagattggattcgtaattaaaaaaaaaaaacttcccacaaagagaagtctaggccaaaatggccttattaatgaattctaccaaatacttaaagaattaacaccaatttcataagttctaccaaaaaatagaaagggaaggaatacttctgaactgattctatgaggccagtatacactgacaccataatgagacaatgacatcacaagaaaataaaattaaagatcaatatatcttatgcatattgatgcaacaattctctagaaaatatcagcaatctgaatccagaaacatattaaaagaattataaccatgatcaagtgggatgcatcctgggaatgcaagatgtatttaacatacaaacataaatcataaatcaatgcaatactttaaattaatatataaaatgacaaaaattacgttatgagcacaatagatgcaggaatctcctttaacacagcccaatactcttttatgataaaaatcattcaacaaaccaggaaaaaaacacagaacttcctcaatctgataaagcccagccatatatagaacccatacggctaaaataatacttaatggcgaaagaccagatgtttttccctttcccaagacaaagctagctactctggtcacttctattcaatatagtattgggggtgctagccaggctaattaggcaagaaaaagaaatcaatgcatctagcttgaaaaggaagaagtgaaactatctctatttgcagattacgtgatcgttatatagaaaaccctaatacacacacacacacacacacacacacacacaagttcagcgaggtttcctgatacaagatcaatacacaagcattagttgtatttctgtgtattgacaatgaacaatttggaagtgaaattaagacaaaaattccttatagaatagtatcaaaaagaaaatgcctagtaatagatttaaaaaagaaatgcaatactttcacactgaaaactaaaatatcattgcaagaagttaaagaaaaactaaataaatggaaagaaaactcatgttcatgtatcagaagactgaatacgtgaagatggtaatactcccccaaattgatctacagattcaatccaatacctattagtatctcagctgccttatttgtagaaattaatgagctgatcctaaaattcacatggaaatgcaaaggacccaagatagccacaaaaatcttgagtaagaagaacaaagatgaagaactcatacttcctgatttcaaaacctgatacaaagctacagttatcaagacagtataaagcataagaacagtattggtataaggagagacatataaatcaatgaaaataatttatattttcagtagttcagtagcaggcttttacagggttaactgattttcagtaagagtgccaaggtaatccaatggaggggaaacaggctcttcaacaaaagttctggacaactgaatatccacattcaaaggaatgaagttgtaccagctcacatgattcacaaaaattaactcaaaatgaatcataggcctaaatgaaaatgctaacactataaaactcagaagaaaacatagaagaaaatcttcagaatcttggatcaggcatgacttcttagcaatgacactgaaagcacaagtgacacaagaaaaaatatataatggacatcatcaaaattaaaaactttttgtgattcaaatgatattatgaagaaagtaaaaatacaatccacaaaaatggagaaaatatttgtaaatcaaatatctgataagggttttctattccaggtatataattaattgttatagctcaacaataaaagataagtgacccaattttaaaatgggcaaaagatttgaatagacatttctccaaaaaatatatgcaaataaccaataaacacatgaaaagttacacagcctcactagtcatcagggaaatgcaaataaaaaccacaatgaaataccacttcattcctactaagatggctaaaataaaaaagaccataacaaatgctgacaaaggtgtggagaaattgtaactctcatatgttactggtgggattataaaatggtgaagccactttggaaaacagttcagcagttcctcagaaagttaaatttagagttaccatatgatccagcaattccactcctaggtatacacccaagagaattgaaaacatatgtggatacaaaatttgtacataaatgtttctagcagcattattaaaaatagccccaaagtctaaacaattcaaatgtccatgaaatgatgaatggatacataactgtggtgtatctatatgatgggataaaaatttgtcaataaaatgaagtacttatacatactataatctggtgaaccttgaaaacactctaattgaaaaaaactaatgaaaaaaagaccacatattgtacgattctgtttatatgaaatgtccagtgtaggggctggggaaagtgggggcggggtagtgactgctcatggttatggggtgtcttttggggatggtgagaatgttctaaagttaagacagttgtgatggtcacacaactctgtgagtacacgaaaaccactgaattgtacatattaaaggagcaaatttaatggtgtgtgaattatatctcaataaaaaataatgtggtgtaaatctggccactcatggttttcacctcccttttttttttctcccctattgggacaattcataagttaccatgctgctggcagctctggcagaaaatgatggtgacagaaaatgacatttcaggaatggcttttaaggcacgaggagcaatagcctgaggataatcagagttgttaggctactctcctgtcctggaaagtgaaatcaacctgattctgtccatcatggacactggtgacttgagttgttgacgaatgttctgtaaagtttaatatcccctgctacactttaaatacagagcccaatccaccatatctttcaaactcaggctatttcaaacataactgaagtagaacttcaaattagagaaacttgaggccttctgatcactggccagaggggaaaaattgttttttatgacctgaaaatgtatttagtatgaaaagaaaatgacttcttaagatgagaataagaaaggggggaaataaccaaatttgaagttctaggtaaatacaataaggcaactgaatagacactcctttctcctgttttctattaggattataattggggattctatctccatccaatagtgtttctgtacacttcaaaggtaggctaactatttaaaccagagacagaacactctgtattactctttttatattgatgtcctgttacaaccatgttttgtttcgttttgtactagagaaaaaagaggactcaaacttatgttgtcaaatatttcctagacacttttgtgtgtgacaggaaggaaacttgttaatactgctgtctcaggtaatactgcttttttagttaatactgcccttcatccctgtgtttaccccctcgagcttatcctccctgttatctgattggtttgtcaacattctgaaccaaaactctattttttaatggaaagcctaaggaggcactttttcctgaaagagattggtgtccctgattatacttactcagagccttctctggattactgggaaggaacacacctgtgcatttgatcttaacaagctctaaatctatattgtgttgctcaggggttgcctgacagagctcagtcccatggtggaagaaacctaccaacctcggtcttctcagctttcaaaggcgacacctgcctctggcctctctctgcattctccccattatgatgtggttctccagaccagggaagagaccagggggaaacacaaactaacacaacaagctccttctggttctgtgtgtagctctttgcaatttccctgctctggtaggcagcactttccaatcagccctgcagctccacctctgagaattcttcatgaggaacaagctttctttagtcatagtcacttgtataagaagagatgttttccttcatgagttgtttgaaatgcagtacagtcattccttgtgttctgaaaagctcccactaaatgacatcatttaattccaggatgctcagaatacttaataatacctttggttttgtctttgcaaaacaagttttgtgtttgtggaagggaacaaatctgaggagtggcaagcggcgaagaccaaaagcttatctgtgtggaattgctgctgtagacaagaacaatataatcctccctgttctgtacctactaaatcttacaaagggttagaaaaatagtatttcatctgtctttgggtttttgataataccaaataacatcaaatggaagcagtctcatggtttcttcattgctaaactaattgttattacatacttgttcctgtgtgatgttaatatatattcctggaaccagaaaggtctacatggtcaaataaatttgaaacttgcattaaataagaataaattgatttttttctccttcagggtttcacagaatctttaataccaatgtgcttttttgaacctcttaatgcagctctggtaggctgactttctgtgtgtgtgtgattattttatttactgccaatctccttaaagttagtttttatttaaaaattatttgtataaacacctgaactatttgactttttaaaaattccattctattgtgttaatagcacttaacatgcgatctacctctgtaaaccatttttaagtgtacattattgttgactgtaaggacaatgtggcacagtagacctctagagcatatttatcttggttgactgaaactttatggctgttgattagtaactccccatttagtaactccccaattagtaactctccctagccctggaaaccacaattgcactctttgattctatgagtttgacaatttcagatgccttacacaagtagcattatgtagtatttgaatttctgcgactaacttacttcacttagcataatgtcctcaaggttcatctgtgttgtcacatattgcagagtttccttctttttaaagactgaatagtattccattgtatgcaactgtgtatgcatacaccacattttctttatccatttgttgatggatatttaggttgtttctatgtcttggctgtagtgaatagtgctgctgtgaatataagagtgctaatacctctttagatcctgatttcaattttggtgggggatacatacccagaagtagattgctggatcatgtggtagacatatgtttgttttttttaagaaacatctatactgcttttcatagcagctataccattttacgttcccaccaacagtgtggagcggtctcaatttctccacattcttgacatttggtgtctttttaaaaaaataatactcatccagacaggtgtgaggtgagctctcatagtgcttttgacttgcatttccctgatgattagtgatgttaagtattttctcatatacctgttgtcatttgcatgtcctctttggagaaatgtctattcaagtccttagcccattaaaaaaaatcatgttactaggtttttttttcttttttactattgagtagtaggaattccttgtataggttggagaataacctcgtatctgatatatggtttgcaaatattttgtcccattcagtaagttgccttttcactcagttgactgtttcttttgttgtgcatgaactttttattttgatgtagtcctacttatttttgtttttgttccctgtgccttttgtgtcatacccatgaaatcatggccaagacgactgtcaagtggtttttcatgtatgttttcttctagcaggtttacagtttcagatctttaaatgtaaaataataatattgaattgatattttgtgtatgccataaggtccagtttcattgctttgtatgtcacgtccagtcttctcaatatcattagttgaagagactatcctttcccattgtgtattcttggcaccgtttgtgatgaccagttgaccatgtatgcatggatttatttctgggctctttattctactccattagcctatatgtctgtttttatgccagtatcatactattttgattactgtggctttgtgatatatattgaaataggacgtgtgaggcctccagcttttttcttctttctcaagattgacttggctaagaattttagcattttgtctatttatgtaaaaaaatgccattggaactttgataggaattgcatttaatctgtagattgctttgagaagtatgaacatttcaataatattagatcttccaatccatgaacatttgatatcttttcatttgtttgtttcttgttttatttctttttactatattttgtagttttcagtctgctttcaacttcttagttgagtttatttctagatattttatttttttggtgctattgtaaatagaatttttttcctaatttcttttttcagatagttcattgttagtgtatagaaatgcaagtaatttttatatattgatttggtatatatcaatatataccaactttactgaattcattttttagttctaacagttttttttttaaatggagtctttagaattttcaaatatataagatcatgtcatctgcaaacaatgtggacaatttcacttcttccctttcaatttgggcaccttttttccttgcctgactgctctggctaggactcccagtattatgttgaatagaagtggcaagagtaggcattcttgccttgactctaatcttagagaaaaagctttcagtttttcatcattgagtatgaggttggctgtgggctaaccacatatcaccttaattataatatgttgaagtaatttctttctgtttctagtttgttgagagtttttatcatcaaaggatgttgaattttgtcaattgatttttcagcatctattgagatgatcatatgatttttatcttttattctgttaatgtggtgctaattggttttcatatgttgagccatccttgaattctacagataaatcccacttggttatggtgtatgatccttttaatgtgcttttagattcagctttctagtattttgttgaagatttctgcatctatgcatatcagggatattggctgcagttttctcttcttttgtactgtctttatctggctttggtatcagcataatgctggtctcataaaataaatttggaagtattcttccctcttcaagtttttggaagagtttgagaaagatcgacattaattcttctttaaatgtttggtagaactcaccagtgaagtaatttggtcctgggattttctttgttaggaggtttttatgatagacagtcttgcctcttgaatgaatatttatatctcaagaagctagtgttctgtgaaagtttgtgaatgaagttttagattcataccctttaacctaatgtaataattaagagaggagactttggacaaaaagtactggattctatttgtgggtctctaccaattaacttcatttacagaattagcatagtaatacttgctacaaatcgagttgtgaaaatttagtgaaatatatgtatactaacaaacaaaaccccaggcacttaggtggccttaaataaatggtagctattattgtgtataaaaaagttagtttagtcaacaccttttccagcaagaagcaagaatttctttcgtttataataataatttaataaaatttcctaaaatgccttctgcatgatgcaagaatgatgaaattatatgcaatgttcagttcgattttagtggttagcacaatttatggtattttattgtttaggaaagggagagtaaagaacatctattgagagtttatttagtactcataccagtcttagggagtaaaaattatctaaccccacttcactgatgagtatgcttcagtaaattgctaaagttcatggaaagcatattctgtggcaatgttagaattcaaacccaggtcccctgactccaaagccaatgctgtctccatactgccataccaccttctttaaaaatgaacaatttggctgggcatggtggctcatgcctgtaatcccagcactttgggaggctgaggtgggcggatcatgaggtcaagaggttgagaccatcctggccaacatgttgaaacctcgtctctactaaaaatacaaaaattagccgggcgtggtggcagttgcctgtaatcccagctactcaggaggctgaggcaggagaatcacttgaacccaggaggtggaggttgcagtgagccgagatcgcaccactgcactccagcctggtgacagagtgagactctgttaaaaaaaaaaagaacaattaattcttgtgtgtacataatagctctctgttaactaaggctattctattcttcacttgtttcaaataaatatctcccctactagatctcaatacagtggtcttaagtcaatttaatcccagtaatgttttatagtcattttctcagaatttctctcatgttcaggtaaggattacataattgaacacaaaattttatcttgtctaagtacttctgacttcacagggaattgtgataaggagtataactcagtggagatgatgtgggatggtaggtggaatgctggccgtggccttagtagtgatcttagtccttcccctgctttaagtccctgtgtgacccagtgagttactctgtatctttaggtcttagttttcttactatttgctctatctacctcatgggagttctgtgaagagtagattaactcacttttccaactctccctatctgtagttgtctcaaagtggagaatgcatactccagggatgagcaggatggttcattcgggtagaggaggatgacatcaaggaacacttataggtgctttaaaatttgttcttttaaaatttacgtttttagcatatgttttataatgtatggacatagcattacatttatgaaaaccataaacacacaaacatatattggagatatgtgctttttttttaattaataggggtaggtgataaaaatgtcgagggcctggtggcctccaggataaagtccaaattctttagtatggcatttatgtcctctggggaccctccagcttcatttcctcccccattgcttctccttctacttaatgaactgaacatactagtatgttttgtagcttcactgtctttgcttatactactctttttgccagagactcctgaaacctctctcagcctcccaccttccacttgaaagactaatttctcaagactcagcaaaggagttatctcctgaataagccctttcctgaacctctcaggtatgccagatcactccttccttgggcttccactgtactgtacacatgccacctataagctgtgtggaagtgtgcttgtttgatttcatttactagtctgtagatctctgtattactctacactgctataaagatactatctgaaactgggcaatttatgaagaaaagaggtttaattgactcaaagttccaaatggctggggaggcctcaggaaatgtacaatcacagtggaaggtgaagcagaagcaaggcacatcttacatggcagcaggagagagagagagagagagtgcaggggaaactggcaattttaaaccatcagatcttgtgagaactccctcacgatcactagagcagcatgggggaaactgcccccatgatccaatcacctcttaccaggttcttcccttgacatgtggggattacaattcgagatgatatttgggtggggacacagagccaaaccatattaagggcaactgccatggcttcttaaatcttttttgttttagaacctaaaatggtccctggtatgtatttcataaatattgattagctatgcaaatagcaaataagctctgagagtactatagcatgttaaaatctccaggcaaatgttaatagttattattattaacctacgttaaattctcataggtttcagtggaatatctttattaaaaatcttaatcaagtgacgtgagcaaaacaatcctaattgacacctgtagacactggttttcaaccccgggagctttcaaaaatatcagtgcccaggctctgctcataggggttttgattcaattggtatgggatatgggtcaggcatctgtggtttttaaaagctccccagatgattttcatgtgcaggcagggctgagaaccattgtttcaaatgtcatggataggaaaagaaaggtgcttgggaaaacctaaggcagagtgctcttcctgaaaatgcaactgcagttgtgaaagcttctgtctttgtaaggttaagatgtgtccttgggggaagacacacacacacaaattgcagttatttattgagaccagactactaagtcacttcgatgaaaacttgagagcttaagactcgccagcatgggctaagaatagatcacattgcagaaaccagaacagtttcttggaaggaatggctgaagacattgacaaaggctgagcagaggatgaaattgggaagtcacccatcaactatgggggttgggcaacgtgaaaatgtgcttaccatttgcaatgaaatggaaaaggccttggtgagaaggcagtggagattaatgataataagtcatgttgagttttaacaagataacatacaggataacaaaaaggcaaaagtttattaagtcagatcctgattttgcaactaacaccttttttcctccctctctttttcaccttgagactgttacagatagctgagtaaggtgccaaattagactcgaactgcatctcagggtgaaaactgtgagtgagcatcagctaatgttatcctaaagtgtatggaattacaagtttctatgaagatgtttttgagaaaccttattaggattagtgcgtatgttgtcaacattggattttctagagaatcagagtgaatatagctggtacataagcattgttaatttgcatcatggatatcaaagccttcttgatagaaattacctatttgcactgcatactaatttgggcattgctgctctggaattgataaaagtttagcctataaattggctgaagttccttttgtgctaagaaagaatttgctaagcagatgcataatgtgccattggccattgcggttaatttttttaagagaataaatatttccaagcacttaagtgccatgtgttacaaatcacaccactcagggactagttgaggcttcttttttccttgaagtcgggcaggcaggacctctagtggcaatggctagttagcagttagatttagtgctaatgttttagaaagtacaaactgcacttcttttaaattctggttgatagacttcaggttgatattccccccaataatttaagctttgcacattctaattccctggtgttcaaattgtcacaagttcttgctgtgtacatatttcttggaggaacacttttaaagaaaatggcttcaaagattcccaggcaaagtggacacctggacctgtaaaaggaacgctgcccctaagatgtggaaagaggccaacaaatgttttaattggttcttgacttcagtactactgactttttctcacatggcacactgatgcccctaaatacccatttgtcctctgaatttggtctttcaaacaagggtgagagatgattttgagagtgagaagagagctgttctactggggaaaagggcacagggagggagttttgacaggtatttgtggtggccacagccagtgataaagcaaacactgcagctgagttcaggccccactgtgaacgggcctgcagttacatctcactcctctcttctgtcagttgggtcccatggggtccactggcaggacccactccaggcaggtgtccctgagcctctcctaaccacctctttctcctccatgtctttgctctctatgtggcgggggcaagaggggagcaaagggcagtagtggcttgtgtgcaggcagccagatgggagcctgaccttgggtcacaggcacacgaaaggcacagcctactgatgcactatttggcctgtgctgtgaggaggggggtgcagagggagagaggaagagagaagaaaactcctttcttctatctctaacctaggcatctagtgcatttcagtcctgaattctttcagggctcagctgaaactgttacttcagaacccttccctgatcaaggtcaggccttccacgggctttttgtagcttcctgtgcttgtctctaccagcacttattattattaccatgaattacttgtgtaaatatttattatctgtgtcagtggatgataagcttcatgagagcagagattggtgtctgtactatttatttttgtattcttatgcaggaggcctgagacaaagtgctaaataaatatttgttgaatgagtgagtgaggcaacaaatgaatcaatgagatacacaagaacatatgtataagaatgttctttggaaataacctagagtctagcaagagggaaacaaatcatggagatccatttgtttgaatatgtcattgaaaggcatatctcaaaaaatatttactaacattgaaaaattctcagaatgtaaggttaagagaaaaaagtagggacacaaaaattgacatatggtatgattcctttttctttttttgacataaagaaaatacagagaattcttactattcatggtagttatattctataaggtcactacaaacactgaattgcaaatactgaatgattgcacctaggggaaatacagagttaggctcctgcaagcctctggtcacaatatttttgtcaactgatcaatttataaccttgttttatatgtgtttctgtttaaagacaccttcttttaatatatattattgattacttaacattgaaatcatgaccaacagcactgtcacttatgcctgaaagaagcttatctaataacacacgtattttctcaagacacatcacagtcttgctatgctttggacaccagacagtgcttcagctccatgctgcaggcgattttaaaccacaagaccactaacaaaaagcatataaatatgaaaaatatagcactaagtagatcttagaaaagatacttgtttacagtatgagagctgaaacaagaaggagaggcatcaccttgtttgacttcgcctgggcatgtatgcatcagccaactcaacctttttgctgctctgagcatgtgcatgcccacaaataactgaaatgcactgtgagtattgatttgcggttacaattcaattttagcaagtaggggaatttgcaaatacaaaatctgtgactaatgaagattgactgtatgtccttaaaacaaaaaaaatctcagggcaaatctgcccctcgtggtagcgggactatggtgacataaacatttaaagatgtatccttttctttaattcctcaaatttctaaaattaacttgtattattgtataagtaggaaaataaatattatttttcttttattaggaaatggcaaaatgtgatgggcagaatatatatagagaaagggtagcaaaaatttctttggccagctgtggcacagtaagtttaaacgtaaacagccaaaactgtcagtagagtagtttcaaaaacatattgagccataactttgaaatatattttgagccgggcacagtggctcacgcctgtaatcccagaactttgggaggctgaggcgggtagattgcaaggtcaagagtttgagactagcctggccaacatggtgaaacctcacctctatcaaaaatacaaaaattagccgggcatggtggtatgtgcctgtaatcccagctactcggaaggctgagacaggagaatcacttgaacccaggaggcagaggttgcagtgagctgagatcgcgccactgtactccagcctgggtgacagagtgagaccctgtcttggtgggaggtgggggagcggggggagggggaagaaaaaaagaaagatattttgaattctctcttatatgacttttgtgaatggccaaagtatcattctgtagtcaggaacaggctgactttttgagccagggcttcaagctgaacaggagaaagagacataagcatgaacaagacctatctctgcaagcagaggtcagccacttgacaaaggcagtgcaaaggggatggctttctccggaaatccctcgcttcagctactcatcctccacctcctgccaagtctaggttaggttcccctcagcagaatgtccttctctgttctagcactccccacactgtgttgtcattacctgtatatgtctgtgttcccaactagactttaagctctatgagggcaagggctgaatgtagcttgctcactattgaattacattgcctgacacattgctttgcacgcagtgagggtgaagtaaatatttgttcaatatataacggaatgattatgcatcaaacaccccaactgatagcgactcctgtgagaatcgtcctctttaaatataagtcggtgtcagaaacaacgccaaacctcaaaaaagaatattgaagagttcaaatgagaaaattcaaacaccccaacagacagtgcctcctgtcagaatcgtcctctttaaatacgaagctcagtgtcggaaacaacaccaaatacaagaatagtgaggagttcaaatgagaaaatttcagtcttaaaaaatagacaagatttcatatactcaggcaaaaagagatagaaataagaatctgcctacgtgtgaaaggcaaatacaattcctgtttcctttatcttcttacgattgtacaccctgttcaaccatctttgggcttgtgattactgggtagtacactgctatttcttgaagtgtccataaacacagatagcagagctcaattcctgaaatgtgctcctgtttgataaggtggattggactggatcttgttcagcctttaatctacttccttaagcatctgaggatgttccaaactcaaggctatttcagtacctttgtatttgcaatgtatgatgctttaaaatgataactgtattaactttctatggcctttataacaaattgctgcaaacctaatggcttaaaacattgtaaatttattatcttatagttctatttatcagatatttgcccagatcttactggacaaagattaaggtgttggcagggtacattctcttctggaggctctaggagagagtccatttccttgcatgtttcatctgtagaaggggggctgctttcattgtcttgtgcccaccttcctccatcttcaagaccatcaggctgagttcttcccatgctaccatctctctggttccctcttttcattcccccttccactttcaaagacctttgtgtgattaagcccagcaaaataatccagaataaaaaatcttattttaaggccaaccgtttggcaaccttaattccatctgcaactttaacccacctttgccgtctaccctaatatattcacaaattctggggagtgggatgtagacatctttgggagttgatatagtttggatgtttgactactccaaatctcatgttgaaatgtaatctccagcgttgcaggtaggacctcctgggaggtgttgggttattggggtggatccctcgtgaatggcttagcgccatccccttggtgatgaatgagttctcagtctattagttcacacaaatgggggttgtttaaaagagcctgggctgggcacggtggctcatgcctgtaattccagcactctgggaggccgaggcggttggaacaactgaggtcaggaatttgagaccagcctggccaacatggtgaaactccatctctactacaaatacaaaaactagctgggtgtgggggcacgtgcctgtaatcccagctactggggaggctgaggcaggagaatcgcttgaacccgggaggcagaggttgcagtgagctgagatcacaccattgcactccagcctgggtgacaagagcgaaactccacctcacaaaaaaaaaaaaaaaaaaagcctagcatctctcttgccacatgacacgctggctccttttcaccttctgccatgattgaaagcttcctgaggccctcaccagaagcagatgctggcgccatgcttcctgtatagctttagaaccataagccaaaataaatctcttttcttaataagttactcagcctcaggcattcctttagagcaatgcaaatggaagaacacaggggcaattgctctgcctaccaaaataaatgtacacactattatatatgcatacaaactaggaaatatagtcatttatatttatcaggattcaaaatatcatgtccctatcccaactgtctactgtctgtcccctcactgcccctgaaaaaaagaaaaatatcctaagatgcaaacactcaaaccatggaatgaaatactcttggagataaaaaagtcaaatacttctcttgctatgcggatttaagagaaacatctccacagtatcagttgtgtgggagtttatgtgtaggaatctaactgctcatgagttatctccatgaagtcccgctcacagtatgaatagatgggatcctgttataatctgcttactgtttgccttgcagttgtgcatataaattatgtctaaacccttttcttcttaatcattcttctttcagaaattttgtttatctttctaatttgattagacaaggctctcctatcccccactgcttttttaacagcacagagatagcaggaggattgatcagtgactggagatccacaggggtgataagcttttctgtatatttatgtagaaggcaaaacacagcagaatgagaaatatcagattccagatttcatgtcccatatgtccccatccaaccctgtatcatgcattaaacaaataaaaagtaacagaagggcccagcatgttggcttctgcctataatcccagtactttgggagatcgagatgggcagatcacttgagctcaggagttcgagaccagcctcggcaacatggtgaaaccccatctctacaaaaatacaaaaattaggcgggcgtagtggtgtgcacctgttgccccagctacttgggaggctgaggtagaaggattgcctgagcccggaaggtggagtttgcagtgagctgagattgtgtcaatgcacaccagcctgggcagcagagccagaccctgtctcaacaaacaaacaaaaaaaaaaaaaaaaaaaaaaaaaaaaagggagagagagagaggaaataagtaacagaactagcagcatttcatattccagctaccttttccccatttacaaactcctgagtctgaaacatttgttatatttggttttgagtgaaaccagaatcaataacaaatttgttttgcattcattcctcaatatatttactgcgtgaatatggatcagcagggatggtgtgagactgccacactcaagctgggcgtttgtgcaatccacatcaacacttccaatactctcaagcaaggccaataaatcataaagctcatgtgctactgaattcagcacttcaccatcggcaaaatcaatggagatgcttccagaattttcagttttacagcttcttgaacaaatcttttcccctagtccctctctttgtctgtctggctaaggttgaggcatggacactgggtttgcctcctctccatccaccttctccatccccttttgagaaatgaccacgtggttgaggtcgatcttgtagtcaagccaattgtggtttttccatccctattcccagtgaggcaacttgttgcatgtcattcccctggcaaccaagactggttcagtttgggttgattcgatgctagcagaagttttttggggcttctaggtaaagcgtcctcatccttaagtgaaagtctcaaagagtcatctttccccatcccaaactgattctagaacttctgcaggcatcttattatagatctgatgaagtaactgtcctagaagaatcacagggaggtggagctccttccctatccctgcactcacctctccagttatgcaggaatatatgcattattcttttgtttgtttaatcctgtttgagttggagttttttgttatatttcctcattcattcaacaaataattacaactgtctgctgtgtacaggcactgctttaagcaatgtggattaaaagaacaaaaagggttcctgccttccagtaggaagagtttaaaaagcaaataataaatctaataaatcaggaaactcaacaagaacaagataaagaactagagagtgacaggagctattgggggaaagatgagagcagctgactaattttaaatagggtggtcaggtttcacctcattgaaaaatgtgatttggctcacacttggaatcccagcactttgggaggctgaggcaggaggattgcttgagcctaggagttcaagaccagcctgggaaacatagcgataccttatctctactgaaaaaagcaaaaaagaaagtacaggcatggtggcacacacctgtagtcctagctactcaggaggctgaggcaggaggaccacttgagcccaggagttcgagacggcagtgagctatgattgagccactgcactccagcctgggtgacaaagcaagatcttttctcaaaaaaaaaaaaaaaaaaaaaaaaaaaagtgtgttttgagtagacttttgagtgaatgagcatttgtggatatttggagaagagttttctaggcagaggatactgccaacacaaattccctaagttggaagcttgcttgggaatgtgagaggagaaaggagtggtgggagtgaagtgagggagggcaggggttaacagggagccctgtgggtcttttagcccagtgcagaagcattttgtttggctttgactctgattcaaatggggaaccacagaaggcttttgagtagagtgaaaaagatcactctagctactgtgttgggaaaggattttggagcagtaaaggaaggtgcagggagctgacttagaaggccacagtcccatgccaggctggagatgctgcagcagtggtccagggttgtagtgatgaaggtggtgagcagtggtttggattctggatatgttctgaaggcagagccaacaggatttcctgagtataggggaatgtgggagaaaagcaaggagtcaaggatgactccagctgaaagcaacctaaatcattaactctcaaatttacctgacttgattatcagctatttacaactcatgaatgttacataccatggagaagtccaacccaaacacagggttcacacgcaaaccagtaatttgatattgagggctctacatgttccattaatcacatccccctacttaaaatattttccttggctgccttttaagaataaagttattttccatagtctttgagagttaactcaggtaggaccgaagtgatgaccgttctgtcctctgcagcaacgccattgccctttatccttgttgtgatgtggttttcctgtgtcttctgctgctagatgtgatgacgatatccctcctttgttgatggactcagcatctgtacatgggatattttgactccaattttcctgatgcatcatcctaattgtctggtagttactgactgtcacttaccaaccggtgtgagatattcttcagctcttcatcaggaacagaattacagcctctatctttagaaatgatatatgctgaggattattcatgtttgtaattacaaatctagcagaagtgcaattattaaaaaaaaaacccttggaaaggacattttgttgtataacgcagaacctgctgttagcctcttgtgctggtattacttttgttgctgtaattgccacctgcatttcagttgtaatttaacattatctgtcttctctgtatctttctacctgattgtaattgttaggactcctgccatttattcttaaatactttcttgtctttctgaattactgggctattttctatgattataacctaagaaacagctgcagcaacccttgttgcattgtaaaaacttcagagggctggtttatctctagtttaaaaccagtgaagcaaacagtggggggaccttcggaggtcattcacataaaaccatcattttaagaatgaagaaactgaagcttttgagtgattaactaagttgctcatgatcatttacattcttattgttatgctgtactctggagtagcaagtatggatatatattcagagataggatcttttaagtcctagcactttgcaatttatgctgattaaccaacgacctgccaaacagagctcaagatgggaagggaagcgacactaaatcctttttttgagccagatactgctaggtgctttgtatcatggaccacattgatatgcacaataatctgatgaggtaggaataattatgccaatttctctctctctctctctctctctgtctctcacacacccacacccccccccacacacacacatgctgggatttttgggagattaagcaacaggctcaagagcacacgggtagtaactctcaaatagtaagaactgcttgactttccaccctttctctttctaccaaatcaggaacagaataatggatatcttccaaaggggtgagatatgagcatgagctactttttttttttttttttttttttgagatggagtcttgctctgtcgcccaggctggagtgcagtggcgtgatctcggctcactgcaacctccctctcctgggttcaagggattctcctgcctcagcctcccaagtagctgggactacaggcacgtgccaacacacccagctaattttttgtatttttagtagagtcagggtttcactgtgttagccaggacggtctcgatctcctgacctcgtgatctgcccgccttggcctcccaaagtgctgggattacaggcacgagccaccgcacacggccaggtatgagctacttttaaggcagttggaagcccaaagagcttgggaaaccatgaagactaggcctcacaactgcagttttctcaggcctatgcagctgcctccatccttttgctctgagcaaaactggacctagttaagcaatgttgcccaactgttaaaaaaggaagctcaaaactaggaggtaggatgccagataatttgtttaaatttttgatctttaaaatcttgactctttgagcttgttttgagcctcattggtccaaagtggctcaatctgactgaggaaggggttggaggaggaaggaatgtaaaaatgaaagatcggtgggaaaaggatactgccttaggttgtctgtaggtaaataaaggtttgactctataaaaactctcttcctgaaataatcaagaatgcttcacatcagaagcatcaattaaatggctgccttctttttgttaattctttagtctttagctatttctgctgttgctgcagaggcagagagatggtgaaagaatcaacctcaggaaatagtatggaggtcaagggtcagctaagaggatctactgattttctgatctgcggagctttctgagtgagtctcccttgaattgcaggagggcatccaataggaaacccagtatgcaacaatctcaagagatagcctctagaacactgggattagcattaatccatgaaaatgaggtgctataatgatgatgatgatgagactagaacctatagttacatgcattgtgggaaaggtttgaattgaaaggctgaaggagggagtggttgtcttccaagagggtatgatggtcatgctgaatgaagaatgaagtgaaagaagtcagtgaagatgcattaagaccgtaggtcaggttcaagtagtaactcccaagggttcaaccacataatgacgcattgaaggatgtctattacaatcataagaaacagcaaagtggttgagtatagtggctcatgcctgtaatcccagcactttgggaggccaaggtgggcagatcacttgaggtcaggagttcgagaccagcctggccaacatggtgaaaccccatctctaccaaaaatacaaaaactagcagggcatggtggtgcccgcctgtaatcccagctacttaggaggctgaggcaggagaataacttgaacctgggaggcggatgttgcagtgagttgagattgtgtcactgcactccagcctgggtaacagagtgagactctgtctcaaagaaaagaaagaagaaaagaaacagcagagtgtcccatctgtcctgcgagtcctaaggaaactgattaatggcttcaaaagtttatttctcatcaaaatgaacttgattaattacaaatccagattttttagtcctgccccccaaaagtctgattttaccaatgaaaataacccccaggtaattcctgcaagcagcctcactggaaacatctggggtaggtgaccccaacttctgtcattgtgagtttctgtgtgctacctttcttttttggtttttgtttttaataaacagggtgttgctctcttgcccaagctacggtgcagtggtgcaattatagctcacttcagccttaaactcctgggttcaaggaatcctcctgcattgctgggattacagatgtgagccactgtgtcaggctctctgtgtgttccttctaatagtacttctagaacatctcttatttttttcttttccagctcggagattcttaatttgagtttctggggctcaatgaatagggcccaggggatctacaacccccctgaaattacatgcagaatttcacatatatatgagctatgtgaagagtctcaaaggaatctgtggtttccaaagggtttagaacaattgctccaactgttctatttatctcctttctgccctgacccctggagctggttcacagctttttatcctggccagtcttcctggctttagtggacagtacatttgtctttgactttgaaactttacattaactatgagacatagcgtgaaactttggaaagagaggggatcacttctatgtttctattaaaattaatttcctttggaagaatatgcctgtgacagttttcatagaacactgctgtccccattttaatgagaaacaaaaaaattcatccacgtcaccaatattctattgtgtctcttttctcccagaagccgatctctttgctaaaccatcttcagcacagctccagttgaagtcctttgcttgtctgggtcctttgttgccctcccggtgttctgctgtccacagaatatagccctgactcggtagcctggcatctgtgccctttgcaatctgactacctcctgctgctctcctaattgttccatgttccaagctaactgtgctcctcgccattgcccaagccctgtctgtgccctcttccctctgggcctacaggggatgccctccctctcctctccatctgtcaccgtgtacccttgttcaaggccttcatcccatctctccgtcagccagaaatttcctcttctgtgaacatcaattgtacttggttcatacgggtcttatggcatttgttacatattgatttttgtttgattatgcatgatttgtgtttctcttttttcttattagattccaagacctttcatcacagggcctttgttgatttaactgtgtatctggtcaattgcctgtcacagtacctagcatacaaaaagccctcaataaaatctggtgaatgtatttaaaaacctagatagggctattttaattcagaaaaataaatctgtttgccttttttcctggtaatctaagttgggcagttgcacgagaactgcatataaactgcattcaactcttgataaattagaaaagtcatctgatggcttcattaaaatgtgggctttaaaattatttatgatttcatttttcataacatctttgtgagacttgtagtagtgtagtattccccccgtcttttggatggtgatttcactgaggtgagaggttaaagtgggtcattcaaggccacagagcaggcaggtaacaaaactggcactggaaccttggcctcctggggccacgttagcagagcgtagcattgactgcactaaggatggaatacaaatgtgcttacacattgtcaaatcctgtgggtcaaaaagtttgttttagtgaaagcatcacagataatgaagtatttgaaattttctcttttcaccttttggcatgcaggctcctctctctctgttccctaaataaggacacgtctgtaggtctgatcctcagccctgtctgtctgtgaccttctccagtatccaggaccctcggcgatcaatacctgcctcgtggtttcaatgatcatcactctgctgacttacctaacgtctttgcctatggtgatgacccctgcctgctctccacctcacatctcttgtggtttaccagaagtttccacttagaattctgccatcacttcaaaatccagatatctaaatccaaactcatcatctgctctctgaacaaacttactcctttctcaatctacatttttctaccataattctcctagtcatccaagttcaaaatcattgttatctttaacttcctttatttttttaagagacagcttctcatcccactgcccatgctggagtgaagtggtgcgatcatggctcactatagtttcaaactccggggctcaagtgatcctcctgcctcagcctcccaagtagctaggactacaagcacacatctctgcactcagctattttttttttttttgagacagaatctcactctgttgcccaggctggagtgcagtgctgtgatcttggctcactgcaacctctgcctcctgagttcaaacgattctcctgcctcagcctcctgagtagctgggattagaggtacctgctaccacacacaactaatttttgtatttgtagtagagatggggtttcaccatgttggccaggctggtcttgaactcctgatctcaagtgatccacccaccttggcctcccaaagtgctgggactacaggtgtgagccactgcgctaggcctaatttttaaatttttgtagaaatggggtcttatgttgaccaggctggtcttgaactcctagcttcaagtgatcctcctgtcttggcctcccaaaatgctgaaattacagaaatgagccactatgcctggcctgttattttcagctttttaattggctttgtcttattgatacttccttcaaaatgtttatcatgtccatttgagaatctagagtggtttttttttttttttttttttttttttttgccaaggattacctctttctctagagccctccacctcatgcacattcctttctttctattttcattaccacattgtgatctaggtcttctcttcctcttccttaaatttcactggtgttcattttgttacaggatgaaatccatagtcttcaacctggcatacaaaacctcccacaagctgactccagttgatctttccaactttctagtctaatacttgcctctggtaattttttttccaattcttctgttgactgtcctggaatgcatcttacatggccttgctttggtcctcagtttagttcttttattttccagtttactcctttggatacttctcatcttcaaggtccagctcatgtctcatctttttgatatgaccattcctaattatttaaatccatattctgaagttcttggcccttgttgtctacatctttgctgctcaaagtgtcattaaatgagcagcagcattgtcaccacctggaagatggttagaaatgaatcttggggctctgcctcagacctgctgaattcaaatctgcattttagcatgatccttgaagtgatgcatgaaacacttgtctgtcccatttagatacttagataatactcaatccaaacaccaacttatgtacttatctgcactcctcaagatccttgaaatctgcgaacctgttttatttttctttagtatctctgaaacacaatttcatggtaaagtaggtgcttactaaatagattttagtgtccttctctttctttttctatttaaaggaggaaaaaactcccaagactcctagaaagtgagcatgagctgctatagtttgaatgtaacctcttcaaaattcaggtattgccaatgagatactgttaagaagtgaagcctttaggatgcgattgagccattagggctcctcccttgcaaatggaacaaggtcagcaaaccaataggagtgctaaggtaaatgactgtagaacaaaatggtgtttatgtagcttgatggtacatgtaatttcacaattgcattttgtgtctgaaaaacatatgaggttttgctaagcttagtagagaaatgcctgctttgtggcaatgttgtccattagttaaccagagagaaatatgagaacagatgatgtcactatattcttccactagcctaggttcttaaaagctctaagactacaagtgttatagatgactccagcatgcactcatactgctacttaactttcttcatggaaatgtgtcttattctgtcaacagactaaaagaggggcaaggacatatattatataattttgtatatactcgataatgctcaggacatagagcttcagttccttccctccctccctccctcctgcccaccctccatttctttattcctgcctttcatcctttaagtgtttgttgagtgattgagatcaaatattgatatattgtatctatagaatagaatattctattctagtgctattatatatgctggggataaatcacgcattaaaatgaatgtccttctctttatggaacttgcattccagtggagcaaaaagataaacaaaatcataagaggaatttatacttagaggacgataagtactgcagaaaaagattagagaagagggcttggaattggggaggtatactttaaaataaaaagccagagaagaccacctttgagaacataatttaagaaaagacttgaaggaggtaaattatgtagctatctgagggaagaccttcccagagagtggaacagcaggtacagggctgaggtgggcatgaacagggaagagtaagaacggtcttttgggtttgaagtagaaggagcttgcaggagaatgacaggagagatgaggtcagatattacatctcaataggatctctctggctgcaatattgagaaaagccagaagggggacaaggtggaggtgggaagacgaattagaaggccactgcaataatacagacaggagatggtggtggcttagaccagggaggcagccgtggaagaggtgagaggcagttacattctgcatatattccgagagtacagccaacaggatttgctgaaagattgaatttggcatatgagagacagagaggcatccaggatccaggcatttaagatttttggcctaagcaactagaaagatgcagctgccatcaagtgagatgggggaaggctgcggtggagaagtcttttttagggaagattaggaacttagctttggcaatgttgagtttgacatatcttttagacaagtggagatattgaggaggcagttgaatattggtggaatgaacgaataaccaggatcttaatcaagtgtttaactcccttaaacataaatcaactttttgtctacttcctcataatgtgaagcactttgggatgtgacattggaaatcagactcttctgaccaaggcccaggtctgcctgaattccaggcctagagatctgacaatgtgctggccatcttcccttaaatgttctctagagccacaccatgtctaaaatggaacgcactctctttatcccaagcctggtctccctctttgtgactgtggtgagtgggcaccactaggcatgtaagctggcagtcacacttcattccttccatttcctcatctccatatctaattggtcaccaaatcttaccaaccccacttccaaaccatctctagaacccatctcccccctccgtcttcactgctgcttttttggatttatgctctcattgtctctcacctggattatatgtaaatcttctcctacctggtttcccagtctccaatcgatccttcacatagctcccagagtgattttctaaaatgtaaatgtggccatgttactcttctgcttaaaacatttccaaaggctttcttctgtccataaaacccaaaacttgagtttggcctgcaaggatcatcaagatctggctcctgcttatctcttagatttattatcccccccatcccccccgtcactcctatccattggccagattatactacctgtagttagttaacttattcattcaattttcagatataaataggatgcttcatatgttacaagcactatgctaagctgtgggggatacaaagctagacattgaaaaagcctgaaataaacctggttgtcttccttcctacttacttacagtcgtcatacagtaagctgtggggatacaatgctgcattgtacgcagacttggttcctgccctcatgaaagtatactttctcaatttccatgcctttgctctctgaaccccctgccttgaatttaccaccatctgctcctccctccatctcactgccatgtcctccttctcctaccagctacttaaagaataccatctcaacttttaagaatcagcttacatcattcccttgtattaagctctttactctatctccttttctcttctaaaaatgtttcctccctcaaaaggtatcattgaaaaacttaatagctctagaagtgaggatatctctaaatacattccaggttcagttcagaatattgttttatcttatactagaagatcatagctcaaggaatgggatttccttctttatcccaaaagggaaaaaagcctccttttcctggatttttcccatgctccttgggctccacaagtgggataagcaattgttaacttgctgcagagtgagtgaacccaattgcattggattcacacacagtggatgctccaggattttttttaaatatttatttatttatttatttatttatttatttatttatttatttatttattttgagacggagtctctctctgttgcccaggctggagtgcagtggcgtgatctcggttcactgcaagctccgcctcctgggttcacgccatgctcctgccttagccttctgagtagctgggactacaggtgcccaccaccacatccagttaatttttgtatttttagtagagacgggttttcaccatattggccaggatggtctcaaactcctgaccttgtgatccacctgcctgagcctcccaaagtgctgggattacaggcgtgagctgccatgcccggccttcaggatttttaaatagtaaagcgttaggggtggtgagctgattggtaggggtgctaggaaacttgtcttaaagctaagtttgcatagctagcttacaattttcacttagattaatatacatagatttatagtagcttgtgggggactgataaagatgtgggttaaagattccttttaaagccatcccttaatgctaccactgtacagaaagatggcagagtgactgcctttatagacacctgcccacacttcctaatctgccctcagttgcaactcctagagagtaggcacacagcttagggtggaaaatacatgaaaattcagtacttgtaaatagatgggaggtgggtaatgaggatgagcgacagaagaaaaaaccttctatatttgtctgttctcaccacctaaggggttcttcagaaaaccagtgagctttacgctcaggttgagaaatccttgttacagtcactttaattgcaatctctatttcttctctctttttctttctctctctgtgtctctacacctctccctcaccactttctggatatgcacacatatttacattcagatgattttagaaagctccattggggaataactataaattatgaatatgcaacagcactaaaaccaactattatagtcaaaaatcctgaaataaacctcctggttctcttccttcctacttacttacagtcagcacacagcaatatatcttagagtgaggctaaatggatatctgatactcactcgaatgtgataggcagtcaacaacccagttatcactgttgaagcattttaaggactacttccatgtcactctggctatgataaaaaccatagtctccaaattggtacagtaggatgaaccttccatgacgactggtagcatgtgtttgattacacatatgtatacatacatgtacacacaatacacatacctaaacattataaccagattagtatattccttttgcattgtactgaatactttaaaataatgtttcatcagtgattgtcagagttataaaatcatttgaatatattaataagctataaacattttaattttaaaggataaaatatgctgcacaaaagagccagtacagccactgcttatgtgtttaatttatttaaagagatgcctgttctgttattacttcaaatatagttatatctacatgtaagtgattttaatttgctacaacatttagatgtatcaatgagacatttcataaattaaaattgtatcacgtagggagactatcttgattatgaagctttattaggtgatgattataagtgccttgtttaataattataacagcttaatggctcctgtagttatactttataataaaaatttcacatttaataatatggaaagggatggtacacagtgaactgacaaaaaagtattgattctgaacctttaaattggattcctattgatctgatgtatgaatattttattggtgtaaatgttttcagggttgccagtttctattactgcatgttagcaattttactggctatgtataatggacaaattaaatgccaggatatgggcatatccagcaccccacactgattattttgattcacttatcactatacactactagggccttccctttctctgtcccatctctgttctggaaggtgagccacagacttcttctgtacatgcctcagatacatgacaagccagtgatgggtggtctggcttgttatctggtagaggctgggtgggcatgtgtctcttcctgctaaggcccacagccccttagctaagacttacacatttgctccaaggccagtcatttgggcccgagtacctaatggataataacaggggctctgggattaggtagagcaagatggctgaacaaaagcttcaaccaattgtcctccccacaggaacaccaaactgaacaactatgcacacaaaaaagcaccttcataagaaccaaaaatcagcttaggtaccagcttggccacagtggagtagagcaccaagcaggctcttggggtccctgattccaggcctagctcttagatggcatttctggacttgccctgggccagaacggagcccattgcccttctgggagagtcccagtcctgccagcattcatcacaagctgactgaagagctcttgtgccttgagtgaacactggtggtacccaggaagtactcaccatggacctagggtagtggtgatcacagggagagactcctctgtttgtggaaaggggagggaagagtagaagaactttgtgttgaggtatgtgttccagctcagccacaatcgagtaaggcaccaggtatattcctaaggtttctgactgtaggacctggctcctggatggcacctctggacccacccagggtttggggaattcactgccctgaagggaaggacacaagcctggctggctttgccacctgctgattgtagaaccctagggctatgagcaaagataagcaatagccaggcagtggttaccacaggtgttgggtgagacccaatgctgtgctgacttcaggtctgacctagcacagtcccaagggcaatggccacaagggtgcttgtgtgatcccacccacagttctaggcagctcagcacagagagagagagagagagatgccatttgtttgggagaaagtaagggaagagaacaagagcctatgtctggaaatccaaagaattcttccagatcttatccaagaccaccaagtacctctaagagaccgcaagagtcacagtgttactagactcgaggtgccccctaatgcagttatggctacagtgaccaaaaacttagatcacaacactcaagtccctttgaatacctggaaggcccttcccaagaagaatgggtacaaacgagcccagacttagaagactacaataaatatctagctcttcaatgcccagatactgacaaacatccataagcatcaagaccatccaggaaaaataatcttaccaaacaaactaaataaatcaccagggaccaatcccagagagacagagatatgtaacctttcagacagagaattcaaaataactgttttgaggaaatgcaatgaaattcaagataacatagagaaggaattcagaattctatcagatacatttaacaaagagattggaataattaaaaagaatcaagcagaaattctggagttgaaaaatgcaattaacatactgaagaatgcatcagagtctcttagcagaattgatcaagtagaagaaagaattagtgagcttgatgacaggctatttgaaaatacacagtcggaggagacaaaagaaaaaaagaatgaataagaatgaaggatgcctccaagatgtggaaaatatcctcaaaagggcaagtgtaagtgttattggccctaaagaggaagtacaaagagaaataggtgcaggaagtttattcaaaaagataataacagagaacttaacaaacctagagaaaggtgtaaatattcaagtgtaaaaacaccaagcagatttaacccaaataagactacctcaagacgtttaataatcaaactcccaaagatcaaggataaagaaaggttcggaagaaataatataaatagagttccaatatgcctggtagcagacttttcagcggaaaccttacaggccaggagaaactggcatgacatatttaatgtgctgaaggaaaaaaaccttttatcttagaatagtatatccaacaaaaatatcctttaaatatgaaggagaaataataactttcctggacaaacaaaggttgagggatttcatcaacaccagacctgtcctacaaaaaaatgctaaagggagttttcaatctgaaagaaaaggacattaatgagaaataagaaaacatctgaaggtgcaaaaaactcacaggtaatagcacagagaaaatcacagaatattataacactgtaattgtagggtataaactattcatatctcaagtagaaagactaaaagatcaaccaatcaaaaataataactacagccacttctcaagaaatagacagtacaataagatagaaatagaaacaacaaaaagttaaaaagtatgcagtgggggggaatgaagttaaagtgtacagtttttattagttttctctttgcttgtttgttagtctatgcaatcagtattaagttgtcatccatttaaaataatgggttataagatagtattttcaaacctcatggtaacttcaaatcaaaaatcatacaacagagaaaaaatatgcaaaaaataaaaagcaagacattaaaacataccaccagagaaaatcacctttactaaaaggaagaaagaaagaaaagaaagaaggaaggaaggaagagaagaccgcaaaacaaccaggaaacaaatatcaaaatggcaggagtaagtccttacttatcagtaataacattgaatgtaaatgaactaaactctccaatcaaaagacagagagtggctgaatggataaaaaaaaaaaacaagattcaacaatctgttgcctacaagaaacccgcttcacctataaagacacacatagactgaaaataaagggatggaaaaaatatactatgcaaatgtaaactgaaaaagagcaagaatagctatacatatatcagacaaaatagatttcaagacaaaaactataagaagagacaaagaaggtccatatatgatgataaaggggttacttcagcaagaggatataacaattatatatatatataatatataatatatattttcacccagtgctagagcactcaggtatataaagcaaaaattactagagctaaagagaaagatagacctgaatacaataatagctggagacttcaacagtttcagcattgaacaaatgatccagacagaaaatcaacaaagaaatatcagatgtaatctgcaatacagaccaaatgcccttaatagatatttacagaacatttcatccaacagcctcagagtacgcattcttctcggcacatggattattctcaaggatagactgtatgttaggccacaaaacaagtctaaaaaattcaacaaaattgaaattatatcagtatcttctctgaccacaatggaataaaactataataaatcagtatcaagaggaattttggaaaatataaaaacacacggaaattaaatagtatgctcctgaatgaccagtgggtcaatgaagagattaaaaaggaaataaaaaaatttcttgaagcaggtaataatggaaacacaacataccaaaacctacgggatacagcgaagccagtactaaagagaagtttatagctataagtgcctacatcaaaatagaagaaaaatttcaaataaacaatgtaacaatgcatcttaaagaactagagaagcaagagcaaaccaaacccaaaattagtggaagaaaataaataaagatcagagaagaaataaataaaattaaaatggagaaaacaatatgaaagatcaatgaaacaaaaagttgggtttttctttttctttttttcctttctttttttttttctgagacagagtttggctctgtcacccaggctggagtgcagtggcatgatctcagctcactacaacctgaacctcctgggttcaagcaattctcatgtctcagcctcctgggtaactgggattacaggtgtgccaacatgcctggctaatttttgtattttttgtagagatggggtttcaccatgtaggctaggctggtcccaaactcctggtctcaagtgagccacctgctatggcctcccaaagtgctgggattacagggatgagctactgtgcccggccaaaaaaatgattttcttaaaaagataaacaaaatttttgtcagttgacaagacttaaatctaagacttcaagctatgaaactattaaaagcaaacattgggaaaactctccaggcaagtgatttcttgagtaataccttacaagcacaggcaaccaaagcaaaaatggacagatgggatcacatcaagttaaaaagcttctgcatagtaaaagaaacaatcaataaagtgaagagacagcccatttaatgggagaaaatatttgccaacgatccacctgacaaaggattaataaccagaacgtataaggaacccaagaaactctataggaaaaaaatctaggccaggcgtggtggctcatgcctgtaatcctagcactttgggaggccgaagcaggtgaatcacctgaggtcaggagatggagaccagcctgaccaacatggagaaaccctgtctctactaaaaatacaaaattagctgggtatggtggcccatgcctgtaatccagatcttcgggaggctgaggcaagagaattgcttgaacctgggaggtggaggttgcggtgagtcgagatcgtgccattgcactccagcctgggcaacaaaagcaaaactccgcctcaaaaaaaaaaatctaataatcccattaaaaactgggtgaaatgtctgaatagacatttctcaaaagacatacaaatgaccaacaggcatatgaaaaggtgctcaacatcactgatcatcagagaaatgcaaatcaaaactgcaatgagatatcatttcatcccagttaaaaaggcttttattcaaaagacaggcaataacaaatgctggtgaggatgtggagaaaagggaactctcgtacactgttggtgggaatgtaagttggtacaaccactatggagaacagtttggaggttccttaaaaaattaaaatggaactatcatgtaatccagtaatcccactgctaggtatatacccaaaagaaaggaaatcagtatattgaagatatgtcttatctctgtactcccatatttgttgcagcactattcacaatggccaagatttggaagcaacccaaatgttcatcaacagatgaatggataaagaaaatatggtacatatatgcaatggagtgctatccagccataaaaaggaattagctcttgtcattgtcaacaacgtggatggaacacgaggtcattatgttaagtgaaataaaccaggcacaaaaagacaaacttcacatgtcctcacttatttgtgaaagctaaaaattaaaacaattgaacacatgaagatagagagtagaatgatggttaccagaggttgggaagggtattgagggtgcggggaagggacggtgagacagtggggatggtaaatacgtataaaaatatagttagatatttagaattaataagatctagtatttgatagcacaacaggttaactatagtcaacaataatttattgtacatttaaaaataatcatttgtaacacaaagaaaggataaatacttgaggtgatgcatacccatttgcccatgcaataatgcctgtatcatgcctgtatcaaaacatctcatgtaccccataaatatatacacctactacatacctacaaaaataaaaaaaaaacccctggactctggagtcagattcattcaattcaaataatatttattgagagccaaatagcagacattgttccaggtgctaggaacagaatcgtgatcctggcttcatggacttccattctcatgattgcctaggttcaaatcctaactctacctcataacctcaggaaatatgttttactgtctgaacttatctcttaatttgtaccagattcatgtttgttgcaagaatttacagaggcaatgtatataaagcatccaatatcatgcctagctcattgcaagtgtcacttatttttatttttgggtgaaagtctgatgcaagccatatttatgccataaatttaattggatgtgaatatgatctactagttgaaatgactctgatttctatgctttttaatctagtctgagcagcatttatgatacagtaatggccaaaagacaatgaaaacactattatttatcttaataagacaatcctaagccaaaagaacaaagctggaggcatcacgctacctgacttctaactatactacaaggctacagtaaccaaaacagcatggtgctggtaccaaaacagagatagagaccaatggaacagaacagagccctcagaaataataccacatatctacaaccatctgatctttgacaaacctgacaaaaacaagaaatggggaaaggattccttatttaataaatggtgctgggaaaactggctagccatatgtagaaagctgaaactggatcccttccttacacctcatacgaaaattaattcaagatggattaaagacttaaatgttagacctaataccataaaaaccctagaagaaaacctaggcaatactattcaggacacaggcatgggcaaggacttcatgtctaaaacaccaaaagcaatggcaacaaaagccaaaattgacaaataggatctaattagactaaagagcttctgcatggcaaaagaaactaccatcagagtgaacaggcaacctacagaatgggagaaaatttttgcaatctactcatctgacaaagggctaatatccagaatctacaaagaactcaaacaaacttacaagaaaaaaacaaacaaccccatcaaaaagtgggcaaaggatctgaacagacaatcctcaaaagaagacatttatgcagcccacagacacatgaaaaaatgctcatcatcactggccatcagagaaatgcaaatcaaaaccataatgagataccatctcacaccagttagaatggcaatcattaaaaaatcaggaaacaacaggtgccggagaggctgtggagaaataggaacacttttacactgttggtgggactgtaaactagttcaaccattgtggaagacagtgtggcgattcctcaaggatctagaactagaaataccatttgacccagccatcacattactgggtatatacccaaaggattataaatcatgctgctataaagacacatgcacacatatgtgtattgtggcactattcacaatagcaaagacttggaaccaaccaaaatgtccaacaatgatagattggattaagaaaatgtggcacttatacaccatggaatactatgcagccatgagttcatgtcctttgtagggacatagatgaagctggaaaccatcattctcagcaaactatcgcaaggataaaaaaccaaacaccgcatgttctcactcacaggtgggaattgaacaatgaaaacacttggacacaggaaggggaacatcacacaccggggcctgtcgtggggtggggggaggggggagggataacagtaggagatatacctaatgtaaatgacgagtaaatgggtgtagcacaccaacatggcacatgtatacatatgtaacaaacctgcacgttgtgcacatgtaccctagaacttaaagtataagaataaaaaaaaatgtagtcaattgtggtgagtcataggagggatgccaagtgtggaatcaccacagatgccagtcaaggctcaacgtgaccagctgttcagggtgctttgacaatcccaagccttgaaactacctaaaggctccttctgagtcaaatatcaaaaaaatggatcccaaatgactcctaatatgatttctcccagatgctctttctgataactttgtttccgacgttgatatctgatgctctcctaattactttggaccactttcttcctggaagactctatatggctcttatcattgagcagctctttgcaatgaagatgggaaaagacctccactatcttctgttatgatctaaggccctcgatgaggtacccattgcctccatgtatcttcctgggaaggcctttctgaggctttggctggtatcttaatttcttgtggaatatacatactggtgttctggtgctgtgatgtctggatatgttgaggtattgaccataccctggccagtggttttccttttgtttatatggagagagtccctgctctggcaagggaagagatgaagggaagagagggtagaagaggggaggggagggaagaggaggggagaggaggggaggggaggggagggaacaatttactgtgcctttttaaaaagagatcagccaataaaaaggtagattttggagacagacaaatctaaaaaaaaaaaaaaaaaaaagaaatgaaggttccaaattgatcacctaaatcatacagtcctttatcaaaatgcctggaagcctgtctaggctggaggttggctaacagcatacactcagctgacccggggagtactgatttattttcctatgttagaagttaggcctcatctgaaaggcagagagaagggcatcatcacactctatgccctatggactgggattggggtgggcactggagactattcaagagggcatttttgggaaaataggaagagagctcatggtggaagacagggaaagtaccagtagaagccgcattctgacaacattccacaaggagagaagctaattaaaaatgggaacctgacataggccaactaaatgagtatctctggggctgggatctggcagtgatctttcataagaaaaactcccctagataattctaacatagccagaggtaaaaacaacaacaaaaaaccccactactgctccagactagtagttctcaaagtgtaattcgcagaccagcacacgtgggtatttgtagaagtgcaaattaacaggaccccccaccaccccagatctactgaaacagaaactctgagggtgggactcaggaatctgtgtcttaacaagctctccagtgattctgatgcttgctcaagttggagaactactgctctagataagtcataccagaccaaaaaaacaaacaaacaaaaaaattaggaaggtcaggaaggcaggcagggtaaaatggatcagggtggaagtccactgtggtttccttttgtactttagagaagaatgaaaaacgcacattgctcacttccatacaactttggagaggggaaggtatctaacccttcacctttctctctcctaaagctccttcctaggagccattaaatgacagaggcctcttggttccaagtgggttttaggatttttaaataaaatgcagagactaataatgaaatttgttggaccatcagaaaggacagcagatggcccttgtgcctaggagggagggagggagggtaaccgctttccagaccaggaaaaaataaactaagaataaaaagaaaaccaaatgattaaaactgaactttgctttacttttcccttttatttcatgaaagcagtgtttgggcacagtagagatatgttaataaaattgaataatgtctcttgcactaagttttcagtacaagatgaaaactgcataagaacatgttctaatgatgcgttggttttctcacagtaacatccagcccccagaacattctctggcagcacccacactctcctgtcctagtgaataaacctggaacaaagctgaaaatctgaggagctgccgcctggatggggaaggatatgcttgtgaaatgtagcttggctctgttgctgacttagatgggagtacaggaaagtcattagtttctctggccctcaattttctcaagtaggaaatgacagaaaccacccaaatgaactgaaatgtcaaagtgatctccacaggcccaggaagagggccaggtgccatagccaaacaggatagcagaaaatcgcacaggctcatggtgtcacattctggtaaatgggcatgatgaaatttaactaagctgaaaaactgagaagtttagtgatcaaatgtgggccaaacattctatgggcatttttgttgttgcttattttaatggtcttttcctcctcatactcacatgctgtgcaaaaattatataattatataaaaaatatgaattatataagtaaagaaccccaaccaaatctcaactgattttgtgaaaaagaaatatcttttttttgcttactcttaagttctttttatcagaaaacaaataccacatgggattattattttaaacacaagctgcatttaagagaaagtgtctagtaaaccttctggggctgtaaattagctgctaattttgtttgactaaaggctgtaaaatgcatttctgggaattattgtgcacagagaacatcctcctaatacttcagtgggcttgaacagagaaatggaatcctattcagtatacctgttactaaactgaggctactccacgacccaggctcattctatctaactacatagccagcttttctggatttgtgaaagatgagattttgggaaagaacatgagaaacaatgagtcattcacagacacataagtagagatttgaaattggtgttcagaccatctaatcttcacatttcctcctttgttcaatctcattccagtctctgaaattttccaagggcctgtttattactctgttctattcacctactgctatgttcagttactgccccctgtttctctaatggagttttgctttcaagactgggcacaactcttctcaatatgtatttacatttttcatttccttatacaagttccatcattttttctttatgatagttttctttaacctgtttattcatttgtttcatttgttatattttcatgttttttatcctggtccttattttcctccatgacacctcttcttatacttgatgttgttctctagaatgctgttaaatttgctacctgtctctttcaaaatttacctgggcaatggtagcacacaaagggccatgcagacttgccaatattaggctggtttggcctagcatagtacctggcacacagcaggcattcaatcaatatctgttcagtgactgcctgaatgaaaatagaaatgatatcagtagttttttgcaataatcttaagcaaaattataaactaataacttccactcctttaaatgtgtgtcaacttttctgtactaattggaaaaacatctagttcatgtggatcaaaattgagtctatatgctacgtagggcaaaggcatgcctggattttaacatctcatcctcagtgactctaatggtgcctggcacagaggagatgcccaataagtttatatgaaatggcttagaatggactaccttctccatgcgactaatgatctgttactacttcctgaaaggttagccattattgatataccacttctagatgctgtgacaaatggcacagctcagcagcaaaagtactttttaaagtctatgggcctccacaggttgagtttgaaaaggatctgttaatcctctgaaattacatgtgatttatggggagaaagtttacaaaattattaatactcttgaaggggaatatgacctccccccaccccaaatttcagaaccacagtggataatgaaagtttctatgctgtaagagcaattaggaagtcctgaaaaacagggaatttagtcaggagacttgagttgaaatcctaactctgccccttgctggctgggtgaccttggccaagttttaaactctttcttatcttcagtttccttattatgacatggtgatgttaatgacaagtctctagacatagtggttaaacttcaacttgaacccaaatttttctggctctaaagcccaggctcttaacatctatcatcctacattaattaaatgagataactgatgtgaaaatgcctgatgtaaatatttgttaaagcaacaacaaaaaatgtcatttgtcaaagtaacaaagtattttttaaagtaacaacaaaagagacagataaccacaaagaaaaggccactttagaaattcctctttgacctattaaagaatgttcaagttcaaaatatgtttgtcattatgattaaaaatccaaccccaaaacttgggtgaagacggcataatctgttagtttggatatatacagactaaggggattctttggaataccctttgtctagagtgatcttatgacatggtacggataactagactcacctaacattcaaatgaagggctgtgtgtcttctatactttgtagacagaggtggcagatcatctgcttttaaatatagagggctcccattctgctaggatccagagggaatgagggtcctatgttacagatgtccctctgcctgcacaaaaggctgaagaacaagccatcatggagtgtgggagatccagctgttgtccatttccagaagaggagtgaatagtggcttaacagagaggacccttgcctggttctctttggaaatttcacagtagtgaggccaggtgcggtggctcatacctgtaattctggcactctgggaggctgaggcaggtggatcacttgaggtcaggagttcaagactagcctggccaacatggtcaaaccccgtctctactaaaaatacaaaaattagccgggcgtggtggcgtgcacttgtaagcccagctactagggaggctgaggcaagagaattgcttgaacccaggaggcagaggttgcagtgagccaagattgtgccactgcactccagcctgggcaacacagcgagactctgtctcaaactaacaaacaaaaaatttcacagtcgttatgaacagataatatgctcaggtattagccatttcattgcattgttttgacaagtgacaggaattaggtttgctaatgttggaagaaaaatctcacttgttgcttttaacttaaaccttttatggttttgagataggtttattcactgggctggagaatgaaggatttatctgtattagtcggatttgatcagttttcaagtagctactcagtgtcaggcctatacattatctcgtttaactctcttaacaccatggtaaggttgactgtatcataatctccatttatcagataaggaaacaaagattcagagaagtcaccaagttgagatcattgcccagctgcacacagctagtgagtggtgaagctgagacacaaatcagggcttccgacgccactttctattacactttactatgctgtgcattcgtgtaaaagcatgatatttttaaagtggcattccagctgccagaaggatatcaaatcaagtactaaagacaatattattagaaatggaaatctggactcaccaagaaatgtcttcagttctatataataggaagactggtattttgcttgatatgggtgtttcaatatcatctgctcctaaaatgcagtctagacacctcttgtgacctgctcaggtgatactaatgaagtttgggtcatttttagcatctacagagaacagagtaagagtgctgtgtgttcaatactattgcagacttatgggataaactggattttcttgctttactttataaagctaatgcctgattacaaatataagtttaaaacaaacctcaaaatttcttggcacccactctttgtggttggtaacatggacatctgtataaaatacccaagaccttcatagagcaaaagtgagtgggaaattaatttttattgggtatataatcatcactagccatgttcaaatactttttctctaaatcctttacaaagatcttgtaagttgggtattattacattcagtttagactaaacgaaatgcaaaaaaaaaaaataataaagaaaatagactcacaaggtaaagttgcatacttgagacataacaaaattaaatttcattctatgatgctgccacatagcagatgatacaagcagtatagaatacccataaacattatgttttaaggtatttccacctgtatctttcttggggcaggtaaatgaaactcactataaaccagttacaggtcctcctttatctgaggttttgctttctgaagtttcagttacctgcagtcaaccatggtctaaaaatattaaatgaaaaattccagaaataaacagtttattacgttttaaaatggatgtccttctgagttgtgtgatgaaatctcatgccatcctgctccatccctccagggatgtgagtcatccctttgtctagtgtatccatgctgtctgcccttagtcagccttcttggttgtcagattgattggtacaatggacacaaggtattaccgtgcttgtgtctaagtaacctgtgttttactattattacagtctattgttatagtttctattttaatataagttattgttggtaatctcttactgtgcttagctgataaattaaactttattatagatatctatctatatctatcacagatatatctatagatacgtacctgcgatatgtatctatatgcgatatgtatagatacatatcacaggtatgtatctatagatacatcggtatatatatgaaaaaacagtacatatagggtttggtactaaccacagtttcaggcatccactgggtggggatgcgggtcttaaaacacaacccttgtggataagagaggactactatatggaaagtcagagttagagagcttttgtaggttatgtagttcaatcttttgttttgctggtaaggagaagaatacaccttaattttgacttcttaactcgaaaagttaagaaacttgtctaaggtcacagagctagtggcagagcaagccaagcatcagtgtctccaaaatccagctcagtgttgtttgtgttatatcagaatgagtaagagttaagataagaacatgagtcttacagctccactatccatgttcaaattcttgctgaatgattggggaaacttacccaacctctctggacctcaggttattcacaagtaatacgaatataacagtatttgatagagccaattaaatgagttaatatttgcaaaatgctgaaatcagtgcttgccccataatgaatactcaataggtatttagatatttttattcttatctttcctcccaagcccaacctagtgtagaaacttctggaatggttgaattgaaggagaaatagtataaacagtataaaaaggtaaactttttaaaaagagaatcatgaagtagtgcttctacagagattgggggatggcaaacaacccatggagtaaattcacaagacttgacacttaagaatccaagagggctgcatgagatgagtccaggtaggcctcgtagacaaatcttagatggagttaactcaggaagccaaggagtatgagccagtagtcatcctgagcaaggataataatttttctttctgcctgccttcttgccttcttgtctccttgcctaccttccttcctttcttccagctttccctccctcttttccttccttccctatctccatccctcccttcctttcctacctccctcccttctttcttcttccctttcctccttctttccttccttcatttcttccttctttcctttcttcctccctctctcctacccttcttccttgcttccttcctccctccctcccctcccttccttccttttccttccttcctttccttccctccttcttcctccctctctccctccttccctacttccctccctcctactttcttctgtttcctctttccttcctctcttcttctttcctccctctcttccttccctccctcccaccttcctccctttcctcttccttcctctttcttccttctttccttcctccctcccatctccttccttccttccttctttctttccttcattcctccctccctcccttccttttttctctacctccctccctccttccttcttccttttcctccttctttcctttcctttctccttccttccctccctcccttcctgccttccacccttcctaccttcctgccttcctgcctgacttcctttcttccctcccccttccttctttcttgccttcctgccttgcagtcaccgaatgttttttgagtgactatgatgtgccaagacccggtataagggtgcacgaaataaagtctctaccctcaggagcttacttcctagtgggggagacagattataaacaaagacacaaataggtaatatactattatgtggtgaaaaatgctacgaagggaaagtcacagggagcatttttgtttggtttttttttgttgttttatatagaatggtcacaggtgcctctctgaggagcccttggagcagacacctgaatgaagtgaagccacatgcctggagaacaaatattcagactgagataagagtgaacacacacctgcagtgagagagagagagagttgggtgtgatttgcagacctgtaggaaggccagtgtggttgggcagagggagcagggaatgtaggcaggggccagatcacccagtatttgtaaactgaggcatggactgaatgatagggcggcttcattcatccaccaaaccacgtgctgagtaatctaccccaattccaaagcatgaacttgacaactgcttcttcatagtaatagatgaaggataaaaaaatttaaaaagcatatagatgagccaacttttatgtgcttaaagtgaaaacaatcatgtctataagacaaaagaaggaaagacatttgacatgctccatgtacctgagattcatctcgtgttaataaaatgttgaacatattacactattggccggtgtttagtttcagctgaggaactaattcctaaagctgcagcctgggggatggggagatagggtggacactgagacagggcatggaggaattcagatggtatttaccccagaaatatttactgaaattgggaatgctgagtcaagcctagccatgctagagggccttgggaaggcagttactagaatctccttgatttttttccaatttcagaagaagcaacaagaagaaagtgtcttgactaatccttctagtgaaagatattcacttttataataaggtgcttgtctacacagaggtttctgagtcaaaggaggagaacgtacaaaatagaccgaaagaagagcctgcctagctgctctttttcttttgtaattaccaagatcccgacggtttatacccactcaactgcaggtgctgggagaggagaggctactgtgacaaaaattatataaagaagagcccagcagatgcatttccagataaacaatgtaaaacatagtctatgtaagtgccataaaatttcactaataaaaaacacacatggctcagggaaacatttattatcaaaatggaagcaggaaagggcatatgctaagtcttattcatttcaataaatagcagaacgtgaattgataaaagttcttaattgaaaaacagttgctcatttgtagtttgatatttaaaagctttctaaacatgtatttattttgttttgccttgaagtaattagctattagactaactattttcttttcatgtcaggtacacagtggctccaaagtcaaaacaaggttagattggaaggaagcaaacaatgaaattgaagggaaatatcgacacttctcaatcaatgaaaatgcatcagcatgtatgagcatctttagctggcaataatacatcagaaataaataatgttagcaaaagagacagcatcattggctattcatagtatgtattcacggttgtacaataaaattctaaaggctgaggttgaaagtgaataaaaattattagttctaaacacttgaaaattccagcagcttagacatatttttgtatgctttcagtgccccaaatgtaaaacttaaatcattttatgaaaaaaccttgttcaatcttttaagaaatttgcatttcattgcaaagatggaacatagcatccttggctgagttattttctatagaagtcagtgccattttgtggtatatgattagcacattctaaaggcaaagattccagaacgtttaaatttagttgtgaaaaactgaaggcatttatccattcatatataagcatgaaaatgcaagcttcactttctcagtatgtttaaatgccacatattataatgggaattctagaagatgtgatcatcaaactctgatttcacgcttagaaatcaaataaaaaagagactggcctataattagaaaattagtcaagtcagatctaatatcaacacatggttgtcacagaacaaaaaatttttgctttgagaaaaatgagatatcattctggatgaatattctgggtcagtagaaaatagggaatcaaagtatagaaataaagtgtttatgtcactgtaaaacttctagttttctaaaataaaatttaaatatctgaaatagcagtttatacttcatactcatacagtcaatagacattggtagcttaagaaagaacttggtaagtgatgatttaaagagtgatatagattcagtagtattcaatatacagttgtaattgatgagctcatcaaactatggaatttgggatatttacataatatttacattatataatatgggagagatagcaagtatctataaagagtttaaattcccatactaggaaatgtatagtttgttttaatctatgtctacatttaaagtagatttttttttcagagacagcatatagttgggtattgctttttaaatttttaaatctaatctttgtcttttaaattatatttaacgtagttgttgatatggttgaatttatgtctattaccttgctacttgttttctatttatcccatttattcttgtttttttccctcaatgtctgccttcttttggattatttgttttagtattccattttatttccattagtggtttattagttatacctccttttaaatttatttacctaattttagttggtgccacaaggcttaaagtataaatctgtagtttatttttggaggatctttgccccacagattccagtcttaccatgctatttattttttagcgatttgattacgctctggtcaatatgtgattatgtgcaaactgtgtgtgtgtgcgtgtgtgtgtttatcttgcttgaggtttgttgaatttcttggatctgtgggcttagagtactcacataaaacttaaaataaatttctatattcttttttctggtatactgtctatgcactcttaattcatatagtcatgtttttatgtcagatattccattttttgtctttaaataatataccaattaatgtataacgtgatccttacaatagttatacttctatttccccatttttcctgctattgtgataatacattttacttctatatatgacaaaaaaccccatgatatacataacagtgtatataataataacatatttttgctttaaatagctaagtcttttaaataaatttttaaaacgagggccgggcgcggtggctcacacctgtaatcccagcattttgggaggccgagacaggcagatcatgaggtcaggagattgagaacatcctggctaacacggtgaaacccatctctactaaaaatgcaaaaaattagccaggcgtggtggcgggcgcctgtagtcccagctactcgggaggctgaggcaggagaatggcgtgaacccgggaggcggagcttgcagtgagctgagattgcgccactgcactctagcctgggcaacagagcgagactctgtctcaaaaaaaagaaatttttttttaaatgagaaaaagtattttatatttatccataaatttaccacttacatcacttcatttctttgtgtagacctgagtttttatgtggtatcattttctattttttaattaattaatttttttttgagatggagtctcgctctgtcgcccaggctggagtgcagtggcgcaatcttggctcactgcaacccccgcctcccgggttcaagcaattctcctgcctcagcctcccaagaagctgggactacaggtgcatgccaccatgcccagctaattttttttttgtatttttagtagagacggggtttcaccatgttagccaggatggtctcgatctcctgaactcgtgatccacccgcctcggcctcccaaagtgctgggattacaggcgtgagccactgcgcccagctatctttctctggttttcatagtttatggcaagaaacctgcagaatttcttacctttgttactttgtgaagtgtcttttttctctggatgcttttagattttttttttttagcaatttaattatgctgtggttaatatgtgtaattatgtgtaagctgcatatgtgtgtatgtgtgtgcgtgcgcttatcttgcttgaggtttgttgaatttcttggatctgtgggtttgtagtcacaccaaatttacataatttggtagccattatttcttgagatattatcccccatccattttttaatgtgtccttttttcccccaaatatacatgttagactgcttgatattattccacaggtcacttaggctctgctaattttttcactactctttttttctacatacttcattttggatgattctcttactatgtcttcaagttcatgggctttttcttttaatccaaatggtcacattttcatgtcagatattcttaatccaaatagtcacgttttcatgtcagatattctgttttatttttgtctgtagaaatcacatttgggctttaaaaaatatcctcaatttctctcctcatttcatgttttcctttaaatacttgcaaataggtttttttgtttgtttgtttgttttgagacggagtctcgctctgtcccccaggctggagtgcagtggcgcaatctcggctcactgcaagctccgcctcccaggtacccgccattctcctacctcagcctcccgagtagctgggactacaggcacccgccaccacgcccagctaatttttcattttcgtatttttagtagagacggggtttcaccgtgttagccaggatggtctagatctcctgacctcgtgatctgcccgcctcggcctcccgaagtgctgggattacaggtgtgagccaccgcgcccggccgcacataggtattttaacattcttgtatgctagttccattatctctgtcatttctgaatctatttctatttaatgcttttttcctcctcataatatgtcacattttcttgtatcttgtctagtaatttttgatagaatgctgaagattataaatgccaggtcatctggattttgacttccttaaaaaatattaattttggttttggcaggaagccaaacaaaaatccagatctaaagtccaagtttctagatatttgcccctcagcttctagcctgagcctctccaaactccagtctctgtcttctgagtcagccaggaagtaaatccaagctgttttgggttacccttccctctgcttatggaccataaattgcctcctggaagaaacctggggcaattgtagaaatcactttttttgtcttcttcctctcagagatcacagccctaagctgcctacaatctgatgtttgaaaacagctgcaccatatattttgttcagttaaattttttttttttaggccaggcatggtggctcatatctgtaatcccagcactttgggaggctgaggagggaggactgcttgagctcaggagtttgagaccagcctaggcaacatagtgagactctgtctctactaaaaataaaaaaaattagctgggcatggtggcacatgcctgtggtcccagctactcaggagccatctcaccgcagcctcgaattcctggcctcaagcgatcctcccacctcagcctcctaaagtgctgggattacaggcaaacaccactatgcccggctattgttcagtttttttttcttttgttttttgttgtttgcttttgcttttttgaggcagagtctcactctgtcgcccaggctggagtgcaatggcacgatgtcagctcactgcaacatccgcctcctgggttcaagggattctgctgcctcagcctcccgagtagctgcaactacaggcgcataccaccacgcctggctcatttttgtatttttagtggagacggggtttcaccatgttggccaggctggtctcaaactcctgacctcaggtgacccacccgccttggcctcccaaagtgctgggattacaggcgtgagccactgtgcccagcatattgttcagtttttaatgggaggttagggacaaattttgatactccattaacagcccaaagcctatttcccaaatctgttttagatacccttagatgaaataattcttacagaaaccatgagaccttaaatgattaatcataattatcaaagaaaactcctgagcagttaatgtcaaatgtaatatgatgtaagtaagttgattgataatattcgtgtcttgttaaaagaggctactttagtctgctgagatactgaacggattttcctaagggaaggagtatctgatatgaaataccagttaatcatcagtcaccaaccattaattaaatggctactttataaaggacattaaactgagcgctagatggagtatgttgttgcagtcatttcatagaaaagtctacaggggtaattataagaaaaagaaattgggtatttcaaagatctagtcactgatataagtggaatgtgatatcaaatgtgaatcaatactttaaaataatttttattaaatgcttattagatacagaagaatgctataaaaatatatgtaaacttaaaagtagtgcttctgaaactttaatgtgcaaacaaatcacctgagatcttgttaagatgcagattctgattcaggagtctggggtggggcctacctctgtagttctaaaaaaaaaaaatccaggtgaggacaatgtttctgctctgcagactatctttggagtagcaagagtaagagaagtgaaactacaatgatcatctgtgtgcccaccactggtgtaagaaaaataactttatttttatctctaatgtcttctgggtaccccctcctgatcccttccctccctcttagaaatgactacttccctccctcttagaaatgactactctcttgaattttgtttttatcatccttttgcttttcttaaaagttttaacacatttgcttgtcacttcaatatatattgttagggtttgcatatttttgaatgcatgaacctaatataaatggaatcatttgcatatatccttcttcaatttttcataccacattatgttcctgaggttaattcatatcattgtaatcatagtttgtataaacttaatttattttcatcactgtatggaattctattgtatgaatatacataattcattttaccgttgttgaattttgaaatttaggttttatactgccatgaaaattcttgcataagttcctggtgcacacatgcaacacttagtcagattatatacataggtgatgaattgctggctcataaggtatacacattttaaactttagtagattatgccaaattgttttctagagtggttatattgacttgttctgccaccaactgtgtgtacaaatgttctggttgttcctcatctgtattagttttatattgctgcacagcaaattgtcacaaatttactggcttaaaacaatatccacatattagatcatagctctataggtcagaaatccaggtgggcctggatgggttctctacttggggtctcaccagtctaaaatcaaagtttcagctgggctgactcttatctagaggcgctgtggaaaaatctgcttccaggctttttcaggctgttggaaacattcagttattggcagttacagactgaagccccttttcctgctgtctgttagctgctaaggaccactctcagctcctggaggccactctcagatccttgtcccatagccccctccacttatcaatggagaccctcctttgcatcaaattcctctcatgcttaaaatctctctgagttggataaaagtcaatatataaagagctaatgtgattagattaagcatatccaggcaatctcccttttgtcatataatgcaccatagtcacaagaataattccagcgattaaagttatgagggtcatctatagaattctgcctactctagtttactgatagccagactggccccatgattcactactgtttcataggtaaaatatattcaccacttcccaaggttcctagtgctttgattccattacagcatcagttcaaagtctaaaatctcaataaatcatctgaataatctaaaccagatggaatataaaaaggagtcagcaatccaaagcagtgttgaaatccagtggagcaaaactggttgggaaaactccactgagtttcaaggcctgggaataattctctttagctctcagctcctccctctccacttttggtttcaccctctgagtcaactttcttttttcataaagagtagatgaatagttttatctccctgcttctcgcagtagaatttgagcagatgtaagagtctcttttcattttatactctctctgtcccttttggtccagctggtagtatttctgctgatacaattttctcaagaactttctggatctcctgtggatatcacagtgattcactgcatcatacagaacacatgctgacaagtcttttgagataatcccttctctatttttggcttctactgaaatggttgagggacagaacccttaagcccagaggtcctctggtttaactgagaagatctgtgagaaacacccttaatctcctggaagggtagtttgtgtggtaaaatactctggccttttgatatttctgagttttcaacaaagaactgtatagtatacactcagacttttctttatgccactgttttagcagccatttatgacttttagcatccttttgccatctggagaggctgtgaattttctaaattatctactctggtttctgtttaaaagttcttccctcaatttatctctctcctttcacaatttactataagcaacaaggagaaatcaggctgtagctttaacacctttcttggaaatctccttagctatatattaaagttcattgtttacaaattctgctttccacataactgcaagatgcaactttgctagctatttggccactacataacaagactctcccttcctgcatttctaataatatgtttctcacttctttcttagtccgcactgacagcattctcaaagcccagatttttttaacctatttccttatattttaatgggttttctgtggctcatggtggctcatgcctgtaataccagcactttaggaggctgagtcaggaggactgcttgaacccaggagtttaagaccagcctgggcaacatagtgagaccccaacactgcaaaaaattaaaaaaattagctgggcatggtggtgtgtgcctatagtctcagctacctgggaggctgaggtagaaggattgcttgagcttgggaggtcaaggctgcagtgaactatgattgtgccactgtacttcaacctgggtgacaaagtgagactgtctcaatcaatcaatgaatagataaacaaaaaatgaatggaagttcttgtagacaaatatatgtggtttggcttttatttatccaatatgacaagccctaaattttattttatttattattttattttgagacagtctcactctgttgcccaggttggaatgcagtggtgacatcgtggctcactgcagcctcaacctcttgggctcaagtggtcttcccacctcagcttcctaaatagctggaactacagttatgtaccactgctcctggctaattaaaaaatttttttttgcagagaagagatcttgctatattgaccatactgaagccttgctttttaagatgatatttagatcatttacatttaatgtaattatcaatatttttagtttagtttcccaactttctatgtctttttatccaatttattttctcttcttttccttattcctgcgttttttgataagtatttttatgattacattttatttttcaggattggattattagttacacatttttgttttattatttttagtggttgctctagggtttacattattcatcttaacaaataacaccctacttcaaataatataataatatatattatttcacatatagtataaaactcataacttccattttcctcttttatcctttgaatgatactattgtctttcattttacttctaagatgttgtaaacctctcaacaaattgtttacatattttctttagacattcaattatcttttaaaatctttaaaaataagtaagaaaacatgtctcatatttatctacacttttaacatttccagtgctcctcatttctttgtgtaaatcccaatttctatgtagtgtcatttgtactgcctgaagaattccctctaatgtttcatttagcacagatctgccatcaattcatgttctctgcttttgtttgtctgaaaaagccttttttccttcagctctgagatattttttgctggttatagaattcagagttgacagttcttttttcttttagcactttaaaatgctattccattgttttttggcttacttatttttaacaagaagtttgtaataattcttttgttgttctgtgtataatatttctatttttttggctgtatgaaagattttctctttatctttggttttaagcaatttgtctatgatatgtcaaacagtgtttttaaaatattaattctgcttggtgttctctgtggtctgttatctttattaattttagaaattctcagtcattacctgttcaggcatttcttctgtgcatttctctctctttcctttttctacatgttaaaccaggtgatattttaccacagcttgtggatgctctgctcttgtttttctcattttttgtctctttgtattttagtttagataatttttattgtcttatcttcaagtcctctgacatattcttcttctgtgttcaagctgataatgagcccatcaaaggaattcttcatctctgatatattcttccttcatagcattcccattggacttttaatgactttctctctactgaaatttcccaacttttaatgtttgttgtgtatctcttctactggatcttttgttttgttttgtttttggagacagggtcttgctctgtcacccagcctggagtgcagtgatataatcatgggtcactgcagccttgacctaccaggctcaagctatccttccacttcagcctcttgaatagctgggactacaggtgtgtatcaccacacctggatttttattttattttatttttgtagagacagggccttgttatgttgcacagactgttcttgatctcctgggctcaagtgatcctcctgccttggcctccgaaagtgcttagattataggcatgagccaccatggctggctgaccttttaagactagagtcatagttattttgaagcccatgtctaatatttttacctgggccattcttaagtataatttttttgatgtttttatcctttgaaatgagtaattttgttcttgctttttgggctgtatcatattttttattgaattccagaattggtataaaagtatagtagaatgcgatttaaatagtattttcattaaaaatggatacacatgtttttgtgtcaagtaaacattcagaatcttaaagaaaaattgattaatttattctcagaaatgtgatatatagcatacaagataagaagtttgagcaataaataggtcaaaattgtgctgatgaacttcattaaaattttaacttcattaaaaattaaaattttaacttccttaaaaattaaaaataaaatatgtaattcaggaacatatatttctaaagtatcccattatactgaatattttagagtaacagttacaatggtatgtacatggcaagtaaaacagattttgaccttttcttgcaatagtagcaaaataataacaacaacaacataaaaaatcataatggtaaagtagcttatttacaaagtgaccaggagtaacattttatacccactctcacatgtaaagtgataagtggtacagaaaatgtattcagtgggaaatgtgggagagggtactccagagatagcagggagttataatggtctaggtctggacaatcacagcatcatatccctggattataatgattgatttgggaccggtcacagaactcaaacaaagactattagctctaacaagagctgttttgggaccctttgcagttagaactaaagttgtaaaaagataagactagattgacttggtgccattatgtcaccccaaagggtgagcctgaattaaaacagccaaaacacagaaaaatggagtgatggacagcaataagtttctgataatattatttaagtctttggattgagctatgcctaaagatctttttcagttataagaaccagcaaatgattttttcctatttttaaatgtaatttaattatttatctatgtttaaatcaacagataaaattgtatgtatttattgcatgcaacatgatgttttgaagcatgtatacattgtgaaatgactaagtataattaacatgtgcattatctcacagttatttttgtggtgagaacactttacttatactttcagcattttataagaatacaatatattaactatagtcaccacgttgtacaagggatctcttaaacttattcctcctatctaactgaaaatttgttatcttttgatcaacatctccccaattccctccttgcaatcaccttatcccctagtaatcaccattctactctctacttctatgagatcaacttttttagattccatatggtgagatcatgcagtatttatctttctgtgcctttcttaattcacttaacataatgtccttgaggtttatccatgctgttgcaaatgacaggatttcccttatttttttatggacaaatagtactccattgtgtatatgtaacatttttcttatccattcatccatgatgaacacttaggttgattccatatcttggtgattgtgaatactgctgcaatgaacaccaaagtgcagatatctgttttagatgctgattttatttcctttggatattatctcagtggtgggattattagatcacatggtacttatatttttaattttttgagaaacctccatactgttttccatggctgtattaatttacattctctccaacagtgtacagggttctcttttctccaaatcctcactaacacttgctatcttttgtctttttgataatagccattctaacaggtatgaagtgatatctccttatggttttgatttgaatttccctgatgattagtgatgttgagcaccttttcatatacttcttggccattttgtatatgttctttggagaaatgtcaattcagatcctttgcctatttttaaattggggctttgctgtgtttttgttttgctattgagttaactgaattccttatatgttttggaatattaactccttatcagatgtatagtttgcaaatattttctcacactctgtaggttgtcttttcactctgttgattttttcctttgatttgcagctgctttgtagtttgatataatcccagttatctatcttgcctttgttgcctgggcttttggttcatgttaaaaaaaataattgcctagaccaatgtcatggagctttctcctatgttttcttctagaagtttcatagttttgggtctaacatttatggctttcatccattttgagttgatttttatatatggtaggagataaggatccaatttcattcttctgcatttggatatccagttttcccaacaccatttattgaagagactgtcctttcctcagtgtgccttcttggtacctttgtgaaaaatcagctgactgtaaatgtgttaatttatttctgtgtactttattttgttccattggtttacgtgtctatttttatgccagtaccaggctgttttggttactgttattttgtagtatattttgaaatcaggtagtatgatggctccaaatttgtttgcttgtttgttttgctcatgattgctttgtctatttgggaccttttttgatttcatatcaattttaggattgttttttctgtttctgtgaagaatgagccaggcacggtggcttgctcctgtagtcccagcactttgggaggccaaggtgggaggatcatttgaacccaggattttgaaaaattagctgggtgcaatggcatgtagctgtcattcaggctgctcgggaggctgaggcaggaggatcctttgagcccaggagttcaagacagcagtgagctatgattgtgccactgcattgcagcctaggtgacaaaacaagaccccatctcttaagaaaggaagaaggaaagaaagaaagaaagagaaagaaagagaaagaaggaaaagaaggaaagaaaataaaaaaaagaaaggagggagggaggaaggagacagagaaaggaagaaagaaagaaagaaaaagaaagaaaaacagaaagaaaaagaaagaaagtcattggtattttggtagagattgcattgaatgtatagattgctttggataatgtggacattttaacaatattaattcttccaatccatgtgcatgagatctctttctatttgtgtcttcttcaatttctttcatcagtgttttatggtttttggtgcagagatcttttacctccttggttaaatttatttctaaatattttttgtagctattgtaattaggattattttcctaatttcctcttcagatagcttgctttttgggtacggaaacgctactgattttttttttcccaacaaatgatttttaacttagacaaatttacactgggttttatctcctttcaaaaaaatgaggctgatggaaaattcaagagtcaatgttttttttctaagagagaaacagaaaaataaataacctggcattagggtgtagtatggcctggagaaaagagatgctggagatcagcacagcagcaagagtcaggatgataaagagagagagagagagaaaaaaaaaaaaacactaagtaaccaaagataaagtactgagtgggaaaatattacttccaataagggaatctgatccagcacaaagtctgggctctggaggaaagaggcatgagaaagaaaaatataggatagctctttttaagtcaaagacatgaactgtttactccaaattagggcagtgaagacctgagttgcagactgtctggtgatatcttgcctttctgttaggtaagcactagggtggctgagctgagctgctgcaaatgtgacataaccggtttgggactatggtgtgcacctgcttgcgctatatgcatggcatgacccaattgagattatggtgtctttagttggcttgtcctagtggcagcaggtgaggtatccagatctgcacctgaaccgaggtatttgaataagtgatagaggagcaattcaaaaggcttttctgaaagtaagtcagtgagactggttgtgtgatggatgagggacctcaggaagagagaggagtaaatactgatgccaaggatgctagcttggactctggatgaacactgacatgtgtgactttgagtttaacaattgctaaactgtgatcaaaattatgggaggcattacactgaaaggcaaaactcaaagaaaactctaatatagtattagttgaaaagtaaatgggggtaccatgaagataactaaagccatatttggtatacatttaaaatgctagaatatgtcctttggatgtgctgtttgcatatagggtacacagaaggggacttttatcttgttaggttttatttcagatatataatggctctttttgttcccagtgaatttgggatgttctatgtgttgcttaatagtaaaatatttaaatgttaaattattagtatgcaatatgtgttagtataaatcaagtactttcattgaatctctgaagataaatacaaccatgtaatgtttaattttgactgtcttgcaaacgacctgaacatcaattaacaatctaataataatagtaactaacagtttttcatgctcaggcactattctaagtgctacacaatctggtaacctatttaatgttcacaactaccctacgaagcaggtacaattagttctcccatttactgatgaggaaaccaaatcactgggaagttaacttgctgaagtcgcatagctagtaaatagtagaaaccaatattagattctaggcagtctgattccagcgcttaaactcaaacactcatctttactggctacatgttgtatattcacatacacacacacaaaatttaacaaaacacttataaacaaagtactgtgagatctatagataagaacatccagtcttgctgttaggaaatgtggctgggaaaatagaatatttatatgaaaaagataataatagaagacagtgtgtaggaagtgacagatggatggcacagacaaatcactctgcagaggttgtagagaatggggcaggggtaggttacaggacagatggtcttaaactgatggataggacctacctgtaccatctggttcctgcccacctctctaaacttatcttcctgacattcaccaaattctagccacacggaccttctttgtgttcctcaaaatgccacactcttttctgtcccacggcttttacaattgttgtgtcttctgcctggaagactctttctttaaatcttggcaaggctgcctcctttattattcagaagtcagatcattgtgccctctgatatggtttggctctctgttcccatgcaaatctcatctcaaattttaatcccacatgtccagggagggacctgtaatccccatgtgtcaagggagggaggtgattggatcctgggggtgatttccctcatgctgttcttgtgatagtgagttctcctgagatctgatggttttataagtgtttggaagttctttcttcactcttctctgtgctgctgccttgtgaggaaggtgcctgcttccccttcgccttctgctatgattgtaagtttcctgaggtttccccagccatgcagaactgtgagtcaattaaacgtctttcctttataaattacccagtctcaggtagtatcttttagcagtgtgagaatggactactacaccctccttaatgagaacttccttggtgacccaaactgaaatactgcttcactcctaccccagtccactagcctgtttgatttcattcatgacactttccttacctgaaattatctacttgctaacctgcttatggtctgtttctcttcactagaatgaaagctccacgagcaaggatctatgatgcctgtcttgttctcatcttttttattttttccctcaagtagtttctgaagtttctacctcatctacacaatctttctgggctttaaaggctatgagggaatgtccctctttgacttgttttgaagccttgggcctacttatttgtatataagagaatatttttaaatggttctcttctttatatatttaaagcatgaaatgctctgaatatcaatgaacccaatcacatttgggtaatagaaaaggctgttttcttcatagttgattctttttttaaaaatttaatttcttatttatttattttgagagagagtctcattccattgcccaggctgaagtgcagtggcatgatctcagctcactgaaacctccacctcccaggttccagcgattcatacacctcagcctcctgagtagctggtattacagctgcacgccaccatgcctggctaattttttgtatttttagtagtgatggggtttcgctatgttggccaggctggtctccaattcctggcctcaagtgatccgcccgccttggcctcccaaagtgctgggattacaggcctgagccactgtgcccagcctgtagttggttcttttgaaatgttcctctcctttatgggccaagctgatagcatttgctttaccctctccatttcgtatatttatcagccatcaaaggcttttcttattgcttggaacttaattgaatgatgtttttgtttctttaccaacaaatgaacacaagcggctttcgaaaatactccaaaaaacagtgagctgtaggcaagattttattcttcatgtgtgatatattttggtaattaaggagtcaattctttggctaaatgctgaaagaaaaatgatgattattgtgtaggataaagctgtgaattatagaatactttcaactctgtttaaaatctaattaacattaattgttacattaattttccctgtgaaatttactaactgtatacaaaatgatatttaatcttcctaatggaggtctagtgtattcgtttcagtcctattcgtaggaatatgagttgaaatggcaaagttatagttatgttgaaagtaatgaagtaatttttatataaaactaatttattaactatcacattgtaattaattaaaacactcttacttttacacaatgttcctgtttttaaagtacttttgtgtgtgtgtgatatacatatctatatgtacatatatgtggattcccacagcgtcgtatgatacaagcagaaccattaattattatttatccccatacttatgtataatggagtttccatgaggtttaaaaacttcccctgtaacataaggatagtggatcatgaagttcataatttgtgaccttattaagttctaattactagggatacttcttgttttagtttgctagggctgccataacaaagcatcaagatttagtggttaggccaggtgcggtggctcatgcctgtaattccagcactttgggaggctgaggcaggtggatcacctgaggtcaagagctcaataccagcctggcccaacatggtgaaaccccgtctctactaaaaatacaaaaattagttgggcatggtggtgcgtgcctgtaatctcagctactcggaaggctgaggcaggagagaatcgcttgaacccaggaggcggaggttgcagtgagccaagatcgtaccactgcactccatcctgggtaaaagattgagtggcttaagtgatagaagtttcttttctcacagttttgggggttagaagtctaaggtcaaggtgtcggcagggctgactgcttctaaagcctctctccttggtttgcagacggctgccttctccctgtgttttcacacggacttccctctgagcatgtttatgtcccaatttcctctttcttataaggacaccagtcgtgttggattagggcctaccctaatgacctcgcttttgcttaatcacctctttgaagatcccatctccaaatacagtcacattctgaggtactggagattaggacttcaatttatgtattgttggaggataaaattcaaccataacgcttgtgtaaattgtgaagaaaacagtaattaatgtatagcttgttttaaattttctgagtgaatgagttaaagaggctatatgaaatagtaagtgctattttagccaagaaaattatgtctcagcacatgtggtttgtgtttcaaaaatatttcttgagtaaaatgtctgatttatctaatatttttaataatgctataacctttactattttgataatggtagtactacccgacatatattgagtcttaccatgtaccagactgttttaaacatatgccctgtattaacatatttaattattacaagcaacctatggaatactattattgccctaattttaaaaatatggaagctggccaggcatggtggttcacgcctgtaatcccagcactttgggaggccaaggcagatggatcacctgaggtcaggagttcaagaccagcctagccaacatggtgaaaccccatctctactaaaaaaaatttaaaaaattaaaaaaaagagagtaaactctgtgtaagaacgctaaatgacttgtcaaaggttctacggcaattaagtagcagaattggaatgaaacccaggttctcaggctctggaacttttgattagcaggccagtggttctcaatgggtggactctagtttctggctaagatggagtaagaggaaaagatttaccatccaatgtagaacaactaaaaaatgtatctaaatatgtaaaacaatggattgtaagacattggacttcatggaatgaaaggcagtgatccctgcgaggaaccatatagttgccccactttataatcgagagaaagagttcccaggcttgatgctcaggaaggtgatacctgacccctgcagcctgcagttggaacacagcactgagagtccagggagaccaatgcaatcagagtacagggaagaggacaagagtactctgcacagggagcgagaaagagcttcacagacagtcagagggttcccttgaatcatcagaggaaaacagattagtatatacatgtgcagaaactagccatggctggggaaagaactaccgaaggactagagggaacaattgctggaactcatctggggctggaatagttcctgtccccaaatcataactcatgggacattgggtagaatattcagaagaattttgactcggtggggaaaaattagccctacactaaattatgctagttccaccttaccaagcttaaaagaaagacctgaaagggtcaaactgtttccaagttgaagaggaaagggaataaacattcacgaattactgtcatcatcgtgaagggactctggatgtgaatcagtagctacacaagaaccttcagtgtctctgagcatgggaagatgaaaagatttgcttttcatgcaaggaatttaaatttccaatgtcatatatatgaggacaaaatacattagtgtctgagtgttcccagcacttctcctcttcaccccactgaaaagagtctatccacccagattcttcccctccacagctcttcagagagggttctgctggccagattggttcagaaagaaggtattaagaattaccagctgggtgtggtggctcacacctgtaatcccagcactttgggaggtcgaggcaggtggatcacgaggtcaggagatccagaccatcctggttaacatggtgaaaccccatctctactagaaatacaaaaattagctgggcatggtggtgggcgcctgtagtcccagctacttgggaggctgaggcaggagaatggcatgaacccgggaggcggagcttgcagtgagccaagatcccaccactgcactccagcctgggtgacagagcgagactctatctcaaaaaaaaaaaaaaaaaaaaaaaaaaaaagaattaccatgtgaatgatgaacacttcccagtgtttgttgataactgaagtaaagaccttgagatagtgttggaattactgtttggttgctgggtagtatttgtttacctctcacactactttcagatgggctatgttagtcatagctttaaccagattatagatttactgattggatagatgtttactaaaaattaagtgagcaaatgcaaggactagaacaacatagacaatatattctgatttttatttaaaagaaatatgcaaaaaacactataaaattttaccccaaatatacccatcagtataccaaaagtgtaccatgtatgctaacagccatataaaattactaaaaggatatataccaagctattggtaaaaggttatctctttcactggggaccaggattgggcaggtagaaggcagtaggaacatagcaaggagatcctttcactttgtattccgtatattgatgagttgcttgagttaaataaaacaagaattataatttgtcattaaaaaactaaatattaaaaattaccatcttcccagtgtttgcaatttttttttttttttttttgagacaagtcttgctgtcaccaggctggagtgcagtggcgtgatcttggctcactgcactctctgcctcctgggttcaagcggttctcctgcctcagcttcccaagtagctgggactacaggtgtgcccagttaattttttgtatttttagtagagatggggtttcaccatgttggccaggatggtctcgatctcttgacctcgtgatctgcctgcctcggcctctcaaagtgctggaattacaggcatgagccaccgcgcctggcccaggcttcaaaatttttaaacatttaactggaatagtaagtaaccaacaagcacttagaaagtgcctagtgtttatgattcctgccacctcagagagctacatttgtgttcaatcttcggacacttaaatgttttcaatgtatgtaaataattattgttaagattttcctaatttctttgttaaaatggttcatttcaaggttctttagagcttgcatttatttcattttttgtcatgtttcttttctcttagaataaaaaccagcagtcattttaattacccctgataatgttcatgaatactgccttggcctgtcttctggtttggaaccttttcaagggcgaatggatatttgtctggtgttccatgtataacctgtccttgtgccacttttccaatgtggcaggaagggaacaactgtcatctgttctgagaattcagcactgtgtctggcactgtgggaatttacccagactgctttgggggaagacatctgacacttcatgataattgtaattaaccagaaagacactggaattggaggatttgaagggaaatatgacaagggattaagactttgagattacttttggagccagggtgacttaagcacatttaaaaagttaggtttacttatatattattattatattctaaaccataagacattttctaataaggtttctaagaggaacatgtaaacctggatcaaatttaaataaggttactgaaaatattaatgaaaccaatgactgagcattttataaatgagaactgtattgctttaagttggagaaaagctgcaagtaagacaacatatttcttcatttgaaagcttgtgtccttatatgagggacattgacaaatgagtggtgataaaatggtggtctatgtgccataagggcttaggtacataaattaatgttttattaaccataaaaataaggttaaaaggttgaaatgtagccttcatgtgtctatgtaaaaaagaggcagaaaaaaatcctcagcactctagagaagcttagtctctgagcaatcactgcatatactaatatattcacatataatctagaatgaatgttaaataacaaaaatcatgttcgtttttatattttgctttgcctttgggatacgaagtgatggaacgagctcgttaacactgctcatttctggttagaagaacactagaaccacctagtggatttttcatttattgcatgatccctacactttactattgctaaattgttaattgctgagataggccttaaagtaaaatcagtggttataatctctttgtgggtcataatagaaatagtaattgttaatcttcagcagacaaagctgtccctaagtccttgaagggaagtccctgcccaccaaatacttaccaactagcacactgctgcatctagaaaagcacaggcagagttaaacatttggctgctgagatacaccgtgcaactggagctttaaatttcctgtgaaagtcagtgagcaaggtaaactgcagcaattcatctgcattcatggcagagtcaactttcggtgagcaagactagggaactctgcagagcacagccaaggggctacattagcagcttgacctttgtattcaatataaatctgtgggcacacaaactggcgtttctaatcaattttgtttttggagcaaagtagcttatgtggttacagcgtgccctggtcattctgtttcccattgctgaaccaactgggtctccgcatcttggtggtgatgacagatgttacgtatattacattgggatttgggtcagataaatagcaaatattctgggaaaggatactttatgtttttgcaaaaggttataaaataccaaactttagtaaaccctgattctaggccaaaggttaactctttatatctatgatttattaggtatcaaaagaaaaaagtcaggatctaaggggaatggaaaagtttctgctattctaacctaagagctggttgtcttctcctagtaaactaactgttcagcagatgggatgcatcgggctacaaggttggtgctttccagccggcaccgcgtgtgaagggcatgtggttgggctgggctctccaagtctgcatggcttgggttgactataaccaggggaaacacgcagtggctacaactgcttctcctaacaattctcgtttcattctcttctcccacagtgtgaaggaggctaggtggatattctctggggcttgaaatttcacactgcaaattttacgagagtgatgatctcttcctaactctttagaagccaagataggaaaaatttcagtttacaagaataaagcccaatccctcttcttatgttggaatgtccagtaaaatgctaagaaacgggtgggtagaagaagaggaaaggaagaagagaaacagagaggagagtaaggaaaaaatagaaaaggcagaaaaaaataatgtacatgaacaacaacaaaaatagtgacaaacagaatggactatagagataggggagggtagtgaagggcttcagagaagtcaggtgaagggccttcttttcttttctttttctttttcctttttttttttttttttttgagatggagttttgctctgtcatccaggctggagtgcagtggcataatctcagctcactgcaacctctccctccgggttcaagcaattctcttgcctcagcctcctgagtagctgggattacaggtgcccaccaccatgcctggctaatttttgtacttttagtagagacggggtttcaccatgttggccaggctggtctagaactcctggcctcaagtgatcctcctgccttggcctcccaaagtgctgggattacaggcatgagccaccgtgctcggccagggccttcttttttaaagaaaattttattatgctgtgataagaacacaacatgaggtctaccctcttaaaaattgtgtgcataatacaatactgttaactagaggcacaggttgtacagcagatccctagaatttattcatcttgcataactgaaacttcacccctgttgattagcaatttcccatccttgcaccccagtccttggtaaccaccatttattctactctcgcattatgtgaaatggactattctagatacctcctcaaagtgcaatcttgcagtatttgttcttctgtgactggcttatttcacttagcataatgtcatcaagtttcattcctattatatatgtcaacattttcttctttttaaaggctgaggctgagtaatattccgctgtgtgtgtgtgtgtgtgcgcgcgtgcatgtgtgtgtgtatataatattccaatttacgtattcatccattgatgaacattttggttatttccacatcttgttttttttgaatagtgctgcagtgaacagtgggatactaatatttctgagatcctgattttagttttttgtgtttattttttttgagacagggtctcgctctgttgcccgggctggagtggtggcgccatctcggctcactgctgcctcaatctcctgggctcaagtgatcttcccacgtcagtctcctgagtagctgggagtatagaccaccatgctcagctaatttttgtttattttttgtagagacgaggtctcactatgttgcccaggatgatctcaaactcttagactgaagcgatcctcctgtctcagcctcctaaagtgctgggaatataggcatgagccaccatgccaggccccagtttcagttattttagataaataccgaaaagtgggattgttggatcatctggtagttctatgttttcaatatttttaatttttcccagcttttttgaggtataattgacaaaaattgtatatatttgaggtatactatgtgataatttaagttgtgaaatgattaccacaatccagttaattgacacatctgtcatctcacataattaccatttgtgtgtgtgtggtgagaacatacaatatctactttctgagcaaatttcaagcatgcagtatggtattattaaccgtaattatcatgctgtactaatattggatccctagaacttaattcatcttacaacagaaagtttacatcctttgctcaacatctatttctcctacctctggatctctggtaaccaatttctactctctgtttctaagagttcaacttttttagatttcacatataagtagaatcagacagtatttatctttcttcatttggcttatttcttttagcatgatgtccttcagattcatccatgttgttgcaaatggcaggattttcttctttttttaaagactgaataagattttctttttatgcatacatattgtctttatccattcacctgtgatggacacttaggttgtttccataccttgactattacgaataatgctgcaatgaccatggggatacagatatttcttcaagatacttatttactttcctttggatatagacccagaagtgggattgattttattatatagcagtgttgttcttcactttttgaagaactgccatactattttccatagcaacagcaccattttgcattcccacaaacagtatgcaagggttccaatgtctccacaacttcaccaacacttttctcttttcctcggagctttttgtctgttaaaccccagcttcccccagcctgaagcatagttgacaaagattgtatatatttacagcgtacaacatggtgttttgatatatgcatacattgtaaaatgattcaatcaagctaattaacatagccgacacttcatgtacttatctctctttttttttttgtgatgagaacattggctttttgatagccatcctaatagatgtgaggtgatatctcattgtggttttgatttacagtttcctgattaggtgatgttgagcatcttttcacattcatgttggccatttgtatgtcttctttggaaaaatgtcttttcaggtcttgagccccgatttaattaggttattagtatttttgctcttgagttttaagagttccttgtatatttcagaaattaaccccttctccattacatagtttgcaaatgttttctcccattctatggtagtttttttcattctgttgtttcctttgctcacagaagcgttttagtctgatgtagtcccatttgcgtatttatgcttttgtcgctgtgctcttggtgtcatatctatgaaatccttgccaagatcaatgtcatgaagattttcccttatgctttctcccagtggtttcacagtttcaagtcttacatttaagtttttaatctacttggcattgatttttgtgtacagtgtaagatatggatccaaattcattcttttgcagttggagagccagttttctcaacactatttgttaaagaaaccatcttttgcccattgtatattcttggcacccttgtcaaagatcaattgatcatatatacgtgggtctatttctgggctcctgattctgttctattggtctatagtctgtctttatgccaataccaaagtgatttaattatggttgctctgtaatgcattttgaaatcaggaagtgtgatgcctctagctttgttctttctcaaaattattccggctactcaggggcttttgtatttccatataaattttagaattgttttgcctatttctataaaaaatgccatcgagattttaataggaattgcactgaatctatagattactttcggtagtgtggatacttccacaataataagtcttgcaatccatgaaccaggatgaagggcttctatatatagggcatcagttctcaagattggctgctgggcttctcagagcccatgaagataataatgagacactgttagttaattttaatattttaaagtttgatattctatcttttaacgtttacaggaatttgaaattgtatatttatgtgtgtacctatttgtttcatggctctatgaaggcaggaccatgtctcttttactcaccacagaacaactagcaccactgttgtgcagtagagcctgatggttagagctgcacgcatgggcagacctcccggtttgccatcctgctgcgaccactgactaccaatggcacatataccaccaattggctaggctaacaaacattccaagccccattttgccttgttgccttccattatagaggcttgtacaagaaaaaaaaccctacattttactttcccactctcatgctgctgggggatggtcaaaggacacagacttggccaatgaggggttagcagaaagctggcgaaggattctggaaaggctttgaattcctgctgaaaaggaaaaatgcagttgacagatgacactaccctctctcttcttaacttaaacgtggatgtgatgcttggatataggtccgccattctgtgcttctgagggaaagagtcagtcaattctcagagggagcagctctaacaccgtggagccatggaatgaacactaggaacaaatgacctcccagctgattgttatatgagagaaataaatgtccatttgtttcagccactgtacatagggctttctgttctttttcagcaaaacgctcctattacagcagttttgtgacttcaagcaagttactttactctgttttaatgttcccatttaaaaacagggattataccaatatcgtcctcatagggttgtttgaaagactaaatgagataatatacgtaaagagcacagagtaagcactagatagggataaattactatttttattactattttgatgatgggctcttaataagtcttagatgaataagtggagtaggtcaaacccaaagggtatggcttcaacccaaggcaacccaaggcaacccaagataactcatttttttctgtttgagaaaaatgagaaagggtggagaaatgagaggaaggtggggtgcggggaaggaggcagggctaaagtggagccaggtgggtgctgggtgggggggaaaatgccctatgaaaatctcccatggtgaatggtcaatgtgttggggccaacatattggccatgtgtggtccaggcatgccagtatcaacagacactaaataaacattttttttttttggctcattgaataaatgaatgcattgtgagggtgttcattaacaaagaaattgccatctcatccttaaaactgaagagatagaagtgagagggcagaaggtttttctccagtgtcactcgcacacctattataatatttgcctggaattatgtgggtgaagatgcattgctcaataattgcctgtgccctcgcaaggagcagaggagaacatccggtgggagcagaagcagaggcagaaagaacagatttcccacggagtaaaatattctgttctcataaaaagtcccttgctgtaacaaacgagaaaatgaaaaggagagcctgtagaagagaggcagacacctcttaataggcacatctctccaaagtttcccaccaggggccaactgttcattaaacagggaacaaatgcgggagcgtagctgtgatgggctccattccacagcccagtgctgggactgcagtgcgctaggaagggcgtcgctgttgttgctgtggcccggtgtgacagcaggtctggcatgtcagaatcgccctgcacaaatagctcctgtgcagctgctctcacccaaacctgctctgaggaggctcagtgcattctaatccttcctaaaaacatggacagaaagcaatggaaagttgacatgtataaaaggtttagtcatggggtttttaagtggatgcctccatgaaaggatcaactcagatggccacgtttctgaacattatttacatcaaaacctgacataaatgcctcagatctagctattttcttcctctatcctctttttacatgtctccttttccctctcgattgctttagcttgtaacctgcatgcgctttcaaatgtggtaagcaaatagaaagcaagacgccatttgaatagtgaatggacttgtattcctgtttaggaatgtgtagttgcccttgggctttctcagttataagactcataaaataaaaccttaacacagatggaacacacacacacacacgcacatgcaccacttaaagcagatgtgagtcaaaaacatatgctgatgaactcaatttgctgatggcattctgagcagtgagcccactcagtagggctgaagggttggcatagcaactcttcctgggaaaaaatagacagctggaataaaccatgacgatgaaagtcttcttccaatgactgaagaagtagagagaaattgccatctcttctaaccccttcaagcaaagcaccttggttgaggtttatagactaggatcttacaaattagaagttcatgtattttcctaggtcagattctataccttgggttatattccagctaagaaacactttcagataggctgcatggggctgtggggaaagagagagcacaaacctccaaaaagcatggagctttgaccaaagtttatttctgtaacttatcctaaggctatgccgagtgaagacttgtttactctagctgtaacttactccatcacatagcaccattactttgagaaattaacatattcattctcaattatttatcaagtatccagcactagcaatagggacacagtccctgcttttgagggattcatgactaggcagacagcaccctgagtatattaattaagatctgatcccatattagaataatatgcacaagagacttattacctctgtctcctcattcctataaacatttatctgggacctatcttatgtggactgtgctaggtgcaatgccaagggataaagcaagttaaatggcaacagtcctattcgacaggccagggactcaggatcagactcaggaccctttccctcttgttgcaaatcctgctatgtgtgggctcagccccaaactgtctctgaaatctcagaaatgagcaaaggctaaggatgtcaaattggctttgagatatgcctgtagactgataacaatagtgatgatgacgatgatattagttaatacaataaagctaatactgtgctattattaccaggcactgttctaagtactttaaataacttatttcatatactcttctgtcatttagtatgcataccattattctccttcccattatccatatgaggaaagcaaggcactgagttaaaacgactcacctttaactgttcatctatcaggtaagctaaccccggagcctacataaattcttaactattaaataagctatgccacttctcaaccactctgctgaaaactatacaaactgacaggtcctacaattaaaacccaaaatagatataataaagcataaaaaatcagttaggaattttctcttgcttttgctctgctgttattgttgttctccagataagtcccattttaaaatccacagtcaccttaaggatgtgatgtgggagctggagctgtctgcctacccaccagctatttttaaaggaagatgatcaggaactagttatgaaagaatcagattgtttaatctggtaccacagaacttgagaaactatagacttggtaagttggaaaatatgtaggcagaagtgatgtctctatggaaacagatgtgaagattcaagtaaatactaggcctgttggactttttatgaagatagcagaagcttttttccccacttcttcttctataacctgtttattgaggaatctgaccatggtgaggaacaagctagagacatatttttatctctagtcactgcttccaactctgctatgtcgaatctcccaactcttctagacatctctcaatgacatcttggacaggaaccatagtcacttacagtctagtccagccttatagcatatgcaactgcatatccagttcaagattttccattgctccattgatggctacacttattactcaaggatctactgtgggtgtgcttaggggtaactctttcaccttggagagtggtgtgggaatgttcttgttctagtatacttcatcccaaagacccaattcctcctgttttggggactgggagagaagatgagatggcttaatgtctcttggctttctctattgcttttgctgtctctctagcataccctagcgaccactgagactcttgtggggcagagatccacacgttatctatcttagggacatgatgggttcttcgaagtccctcatgagaggcgtgactctggctcaaacatgttcagcccccttcagctgtccaagcccccccaccctctatcagctctaactacactgcttgcatttttctttcctggtgggctgctttactggcatgtggaggagtgctgatatagcaggaagagttttgctacttcttattaagtcctgaaaaggtatctggtgggtgctgtgtttgtaataagatacttagcacctgtttcccctcgagctttgggcctaggtatcagttctcagacaaaaggaaaagtcaatttttataccctattataatgataaactttgattgaaactttggggataagaaagcatcgagatgtttctctctccttctattcctcttttctcctccctccctctctccctccttcctttgctcccttctttccttcctttctttcttccaaatagcaaccatgtaatctaaattatgaatgataaaaaagcctggcaaatcaatgagagaacttagagcaaaggaatttggaatattataagatagggaacaattttagtttcctgagcattttggttgtattaccacctgctccaatcatagactgtactttttcatgcccagaaaagacttctacaacccagccttcatagcaatcagccactcgggactttcttgcagtctgagctcaacctgtcttattttgctctgagttttccagttctgaaggcttgattactggtccaagagtgtcatttaggtagatatgctgaactcacatcatcctcgttacaaattgttatggaaaatcccaaaaatataaaagaaaaaaattttaaaaactagctaagggcactgttcacatgctgcaagatctcacggaggagaagatggaatgagtggaggatacacttgctgtgtgttcatcattgaagaagggaaagagcttgtgaaatgacccctagcagaaactcactggtgctttcaagttcagggtggcagggttgaaggtgagagttagcttcagggaagatggtggagaagaatgtttgctagtatctggaccccaaaggattacacaggatgctggagcctgcatgggctaggaataccattagttcaatcatggtctacacttggcaaggaagatgcattgagaataggtgaagggcatagtcaagaccaatgctaactgtcattccttatggaggaattatggaatctacttcaggctgccatgaaaagcaaagcagagaatctgttgggacaactcgttcagcagcctcagactacagctgcatctttacttatctaggcctctagatcactcagaagtaaaggaaaatttaaacaaatctaaacattctcattctttcactggggtcttcaaagttttgaacacaatctctcagaagaatcaatttctgatacctgaatctttgtaagcacgaacagagagaagggactggacagatgaaaaggatttgtagttcaaagaagagggccattgtggggaactgatgctgagctctcggttctatgccccccagacttccttcttcagttacggtccctgcagaatcagcatccatctgcgactctcctttattcattgaactccttgttttggagaggagaggcatattttctactttatgtagctctccagcccatgatctcctgtggtcaggggctaaggattcctttccctgtttcctagtaatgcataactctatctctccataaggcagggtgggccaggcattcagaaagttggggaagctaggcagaatgtgaaataagtgaagggaattgaagggtgctggaaaacctcccatcaaaatttcctcccccatgttattccaccattaggtaattagctccctggttcttaaaggattacatcacttttctttgttaagagttgagtcatctatgcaaaaaaaaaaaaacaaacaaaaaacccaaaaactgagtgaattaaaaccagaatccttattagttattacctcaggagctttaacagtgtcccacttcaattagagcaaagctcactgggaatgtgtgtaggataaagaagatgttggaggtaatagacattaaggaaggggccaggagcgtggagggaacccaagagacgtgggaggatctcaaaagtgatctttgcctattgccaactgtgactgaggccctggcccatcatttgatgttctctgtcattcttgggagaggcagaggagtgtgatgattaagagcatggactctaaagctagacttctgggttcataaagggtaacagcttagctctgccccttcctaccttggggactttgagcaaataatttaaccgctctgtgcttttttcttcatttataaaacaggagtaatattggtccctgcctcaaagggttgttgtgaggattaaaggagttaacacacataaaatacttagaagagcacatggcatagagtaaatgctagttgttattagtatgctttcaatttcacaaagggacttaaaaggtcagaacccttacttactcctaggaaccactggggaaggagtgaggaccaacatatattgcatatgtatgccccagatactgtatataaaatatctcattgaaacctcacatattgatgaaataggtattacaatatccctattttgcaggtgagaaaactgtgtctcagagggtgagaatctggcccaaggtaatacagctaaaaagtggtaaagttatctatgatatcccacaatgttacttacacagttctctttggaaataaaaatataaacaaatggtacaggcagattaagaacaactccagcattattattattattattattattatttttttttgagacagggtctcactctgttgcccagattggagtgcagtagtgcgatcatggctcactgtagccttagcctccctgggatcaggtgaccctcccactttcaagtagctaggactacaggtgtgagcttttgtttttttttttttttttttttaatagaaacagggtttcaccatattgcccaggctggtcttgaagtcctggcctcaagtgatccacccacctcggcctctcaaagagctgggattacaggctccagcatcaaatgtttacagtagttgtcctcacagaaaatgcatacataactcttatcttcctgactcaatgctcaccttcacctcccaccctgactgcagcctattatccctgcagtcagtggacttttaatccagataccttggctgagcaggctcatagaggaaactggcccacagaaactgtgagaaataaatgtatgttgtttgaagctgctaaatttgtggtaatttgttatacagccataaaaacgaaaagaccaaacagtcatatcctgaatgattaaaaattggttgcataagtaaaagaatgtatttgagttggaagatttggggttttcacatgaaaaaccaagtgtgagtaaaataaccgcagaatagctattttggaattctgatactcaaacacttgctagttgaaggagtgctaagattatggatataacaattgattctagggtttcaaaacttatttcccataacataggaaagctgaaactctggctataaagaaaaggctatttttctttctcttgaaataatttgtactattcattgcactgtcaatagccaagaacatgctagaaattacaacgtgctcgcacatatgggtatttctgctatgatgcaacatatatgtttctaaaattcattttgttttgcaaaatcaaccaatagaaaaacaaaggacttataagaaaaatagggttggggcacaatagtcacaaactgtcagtaacacaaaacaaaaagataaaatctaatcaaattgtggtagcacagtcttacacaagtcaaatgggtaagaaatatgtaaatactacaaaaataagacactttcctttgacaaagactttacatttgcttgtggaagtgggagtcagagcattgcagcttgtgagtttttgtgaaattgtggaaggaaggtgatttgaaatcaagggaaagttgtatcactgatgtggatggatatggcccatgttgagggtggtggactgaggtagctgacatgtttcaggtacgtgcatgtctgttttgtacatcttacctggctgggttcaggtgtgtgcaattttctgtgtttccctagtgtttttcatagactaaacagtgcataagcaaccccaaattcgtgttatgctcaaaatgttctctaataaaatcttgtgtcttgaaaacaagtgttaaaaagtaaaactgaccagatgttatttcatttgaatcttacgataaaagcaataaatagacatgaggaaacagctttagacatagagctagtaaacagtcaaggcagattgaactgaggtcttcctcctctgtgcttttcccattaggccactccaggaatgtctcagtctagcatattttaaatctgtgtgatgctatagtttcactactgcaatttctaagactttatattttcaattagacatttattttactaccaagaagtatcctgatccagaggtactattctcccagccatggagagttcctccaaaagacaaaattctatctttgctaatgaaaatgcaaataaaactgtatcaagagtttcatgattttactaggtatttcccatcatatgtttatcatacagctcaaaattgatgtcaagttttttactctactcttttctcaagttcattcactataaattgaatttcatttttctgcacttgggttgtattttttgaaccactgactttgcttatattagttttactatgatattcatcaatttgtttaaaaaaattcagaagatacctcttgcacaaattcattttataatttaagaactcacttcagaatgttgagactctgttaagtatcaattctaggattatgaagatcctgtctaccacaaagagccccacaaaggtcttttctccctcattcccaagcagtttaacttaatgaattcttctggtagaactttgtttagacggacttaaagcaggtaagagttctttttaaaatacttgtggagtgcatgagtgtgcaaacaaacttaaaagcacatattggctcaggaaagctgaggggaaatgataattttcaacagtccaaaatagccatcctggggcttacagaaagtaaggtagcaattagcctaactctaagcctaacaataacacagtcattaatcctgggtgcccagacacattccattagaggattttggcaacaaaattttgcttttctaattctgagtagatataaacaataatcccttaatttattagtctgtttatcacacttattaagcatttcctatgtcttaagaactgtgccacaagacaaggatgccctctcttaccactcctattcaacataatatgggaagtagacataaacaataattccttaatttattagtctgtttatcacatttattaagcatttcctatgtcctaagaactgtgccacaagacaaggatgccctctcttaccactcctattcaacataatattggaagttctggacagggcaatcaggcaagaggaagaaataaagcgcatccaaacaggaagagaggaagtcaaactacctttgtttgcagatgacatgactgtatatctagaaaacctcataatctcagtccaaaagcttcttaagctgataaacaacttcagcaaagtctcaggatacgaaatcaatgtgcaaaaatcactagcattcctatacaccaacaacagtcaagctgagagccaaatcatgaactctcattcacgactgccacaaaaagaataaaatacctaggaatacagctatgtagggtggtgaaagatgtctataaggagaactacagacttacaaatcactgcccaaagaaatcagagatgatacaaacaaagggaaaaacaatccatgctcatggataggaagaatcaatattgttaaagtggccatactgtccaaagcaatttatagactcaatactattcctatcaaactaccattgacactcacagaactagaaaaaaactattttaaaattcatatggagccaaaaaaagaaaaaaatccagaatagccaacacaatcttaggcaaaaagaacaaagctggaggcaccatgctacccaatttcaaactatactacagggctacagtaaccaaaacagcatggtagtgacacaaaaacagacacagagaccaatggaacagaacagagaatccagaaataagactgcacacctacaactatctgatcttcgacaaacctgacaaaaacaaacaatggggaaaggattccctattcaataaatggtgctgggataactggctagtcatatgtagaatattgaaactggatcccttccttacacgatatacaaaaactaactcaagatgaattaaatacttaaatgtgaaatcaaaaactacaaaaaccctggaagacaacctaggcaataccattcaggacataggcatgggcaaagatttcatgatgaagatgtcaaaagcaattgcaacaaaagcaaaaattgacaaatggggacaatttaagctaaagagcttatgcacagcaaaagaaactatcaacagagtaaacagataatttacataatggtagaaaattgtgcaaagtatgcatctgacaaacgtctaatatccagcatctataaggaacttaaacaaatttacaagaaaaatacaaacaactccataaaaagtgggcaaaggacatgaacagatacttttcaaaagaagacatatatgtggccaacaatcacatgaaaaaagctcaacatcactgatcattaaagaaattcaaatcaaagccacaataagataccatcttacaccagtctgactcttactataaagttaaaaaataacagatgctggtgaggttgtggagaaaaaggaacacttatacaccgttggtgtgagtataaactagttcagccattgtggaagacactgtggccattcctcaaagacctaaagacagaaataccactcaacccagcaatcccactactggttatatacccaaaggaatataaatcattctattataaagacacgtgcacgttgcatgtgtatgttcattgcagcactattcataatagcaaagacatggaatcaacctaaatgcccatgaatgacagactggataaagaaaatgtggtacatatacaccatggaatattatgcagccatataaaagaatgagatcatgtcctttgcagggacatggatggagctggaggccattatcattagaaaactaacacaggaacggaaaagcaaatacctcatgttctcatttataagtgggaactgaacgatgagaacacatggacacaacacacactggggcctttcggagggcagaggatgggaggagggagaagatcatgaaaaataacttaatgggtattaggcttaatacttgggtgatgaaataatctgtatgataacccccatgacagaggtttacctatgtaacaaactcgcacttgtacccctgagtgtaaaataaaataaaataaaaagaactgggtgccagatgttgaaggaaaatagtaagatcttaagaaaatggctttggccgggagcagtggctcatgcctgtaatcccagcactttgagaggccgaggtgggcggatcaggaggtcaggcgatctagaccatcctggctaacacgatgaaacaccgtctctattaaaaatacaaaaaattagcctggcgtggtggcaggcacctgtagttccagctactcgggaggctgaggcaggagaatggtgtgaacctgggaggtagagcttgcagtgagctgagatcacgccactgcactctagcctgggtgacagagcaagactccatctcaaaccaaaaaacaaaaaacaaacaaaaaaacacagcttcaagtttgtagatctatggtcattcagtctatgacactgaacacttcctttagtagctcacttgttgaataacatctagaattaaataggagaaaaaattttcctaatagaactataccaggctttacatgattggtagtcttcgttcttcacaaaccagtttattttaatagatatctcaggtagagttttatgaaggcctcaaagcaattaaaacttcatttgcaggaaggacaatcttatacttaccagaaaactacagctaacatgaatttctttgttagacatttgctatgaaggatctttgagaaaattctgtgttagaacccatgacacccctaacatagctatgccattatttttttcttcttaaatgaacagatgagttttgtaagcaaagtaggataccatgattgatagacctttttgtaaagtatactcagatttgctgaaagagcctacataattcagtctgggtgcagtggctcatgcctgtaatcccagcactttgggagactgaggtgggtggatcacttgagatcagaagttcgagaccagcctagccagcatggcgaaaccctgcctctactaaaaatacaaaaattaaccaggcgtggtggcacatgcctgtaatttcagctacttgggaggctgaggtaggagacttgcttgaagccgggaggtggaggttgcagtgagccgagatcatgccactgcactccagcctgggtgacagagtgaggctttccctctctcaaacaaacaaacaaacaaaaaaaacaaaaaagaaggagattacataactcaagaaaaccatactcgaagcctctctttttaaataatttttatctcaaataagggaaaaatcaaaatggaaagaggttatgatcagtttcaccattggcctacagtattgcttcagagaacaaaataaaagggttcttgcctctccccttgctggaactgggcctgccccagggacttggctgtagggttgcaggtactttccctgtcctttgatcttaatcaccaagggagcaattaaagttccatgtccaggaatcacttagtaaagagtcttgcttttagttagagagttgaaggggttgtgggcaatatctaaatatgctttggacattgtatttgatggggttgagaaataaaaaaaaaattctaggctcctaactaactgaatggattcccctcttggccaagggtgaaactgcctttgcaaaattattacacaaagagaaatctaacatagttgactccatcttgcttctgacttccaagctgtccttggtcattcctgggtgtaggccaagctcactttgggaggaatttagtttatagttttaccttaaaacaaagatgataatagcccttctcaaaactaaatcacctttgtaaaactaatggaaaggcacaaggttaaaattatgagagaggcccgaattctgataggataggcatagtttttatcagcccttacagatcaggaatcatgtgaccagaggtcacaagatttgtgaccttcccatttactcctatagttaacattgctatgttagaacccaagattgtattttgtgggggatgttttccagactgatcctacctgaacttgtgattcatgactcaattgatcctatggcctcacccagaggtagactcagcatacgaagactgttttccataccagtatgattccatccctaaccaatcagtggcacccattccctagccccctgcccaccaaattgtccacaaaaaccctaagctccaagccttcagggagactgatttgaatgataactccagttctcccacgtgagttagctttatatcaaatgaactctttctccactgcaatactgtggtctcagaggattgatctggtctgtgcagtgtacagtgctgggtgattaccagagaaactcgggaagctgagttcatggccttggcgggatgggaggttgaactagtctcactagtatgtaatcacttgtctcactgctgtcccctccccaccttttttaaaggaaaatgtacaaatagtaaacttcctgagaccctctttggaaaaaacagccatagatgcatctgtgacttatgtttttcctggacatgccctcaagctggctcgataaaccttgatgactgagatttatgactcagtcactcattttgattgtcacagtataaagggcctgctatggtctgcatgtttgtgtctctccaaaattcacatgttgaaatctaatctcaaatgtgtgggcattcagaggtggggcatttacaaagtgatgaggtcatgagggtggagcccttgtgaatggaattaatatccttctaaaagaggcccaagggagcttgtttgccccttctgtcatgtggggacacatagtaggcaccatctacaaggaagggtcctcccccagacacggaaactactgttggtgccctgaccttattaattatgattgagacaatcaaatatggtctggctaagagaagaatagtccataacattttgatgctgactccctaaagtctatgttttgaaatattgaatatttaacatgaagagcaaattacaattaggacgtcttaggtccatacaaagtaatattctatggactgcctttggaattactaggtttggtcttgggatcagattgaatgaactcagtatagattctgtgtcacttctactcatgaaacacatttactgatggttaatctaagagtatctttaggctaggtacagtgcctcacacctgtaatcccagcactttgggaggccaagacaggcagagcacctgaggtcaggagttcaaaccagcctggccaacatggtgaaaccccatctctactaaaaatacagaaattagctggatgtagtagagggcacctgtaatcccagctactcaggaggctgaggcaggagaatcatttgaacccgggaggcagaggttgcagtgaactgagattgcgccactgcagtccagcctgggtaacagagtgagactccatctcaaaacaaaaaaagtatttttatatatggcaacatgttgctatatagttatgaaataaagtgttgacaaaacttgactgaatgtaatcatagtgaagccaacgttatgtgtcatatgtcacctgtgcctgttttgtcacaagtgctctttacaaaccacttagcatcttcactttgaggttgtatgctcttatttaatgctccatagagttttgagattgttgtgagttttctattcaacattggcttctccaaagatttgatcattttttaaaacagctgtaaacctattcaaaatttatataacatatatttaaaatataaggacgctttctgatttcaaatgcatctcatgcagttaataaaattggtaattggtaatttagagtcacagataactctaagtaagtcaattaaaactgtgtaagaatttgaaaagaggatacagggcattgaggggattgacatttggtggccaagtcattatagctattgtttggaagaatctgatgatattcaaatgatcaaagcaagtattttgaagaaataaatgatgtgaaataactgataaagagatactttaaactgacattatcctacacttaaatataataaaaatacacagtaataaagcaaaataacagatttgttgtttggctacaacatcaagtcattctcaactacatattttgacaatagtgactctaaatattttctcaaactaagctttcctaaatattttcccaaaccaagctgtttctttacggactttatatgcattaattttatatgaatgactatttttctaacataaaaacaatctttacaaatattttgagaattcaggaataaaactaaagcattcaaatgaccactgctcagttgtacttgagagattttgcccaaaattatttaaaagtgttgaactgtagaaggccttaaaatagaacttgtagaatttcaatattcagaaagtaaagtttgttactatgggtcatactgttgtgaaaaagcagaaaaagaattcagaataatcaaattgaaactattttgctgatataatcaaatatgcctgatgtttgttgtggttttaaagactgtattttctctttggacatttctccatctttctttttttttttggtgtaaaatatacacaacataaactttccctttttaactacttttaagtgcacagttctgtggcattaagtacatctacactgttatgcaaccatcaccatcatccatctctggcactttttcactattcccagttgaaactgtacccattaaacaccaacttcctatttttcccttcctcagcagtcaccattctactttctgtctctgtagattgactactctaggtaccttgtacaaatggaatcatataatatttgtccttttgtgactggcctatttctctattgttttactaacataaaagtattttatctgttattaattttatctagtcagaaactggaaacactgacagaatctttggctgattaattacactacaattgacaaaatactgcccaaacataagtgatttactaaaatatgggacatgatgtttaaaattaaaaacctgatgaaactgtagtgtcagtctcaattgcagttgtaatatttttcctatagccaatgattaaaatgtgcatttgttagtgattttaaattaatttatattaaatttactattttcccatctaaagcagaattaattggtcatttttttggcacatgaattaaaacatatatacactgtctttggtttgctaaaagaatgaatgaatgatataaaggcatctcatgtagaaagatttgttcttgttaattagcaggtttattagaatatggtttctttcatctgaattttggagattggaaaaacaatctccaaaatataaagaatgcagagaagtgcaggagaagagagaatggtaagctaaaaattaccatcaaatgctaagtgtcagacctacacaaacacaaaatttaacatacttaacagtggcatgttcagtgaatatgagcaggagacatgagctcaaatctaatgatatctatgatgccagaaactttgtatatgctgaatttaatccttatgacaactctctgagtcatataatttccccatttttgcagatgtcaaaactgaaggtaagaaacggtaagaaatttgcctagtctcaacactagtcagtgtcagagccagaattccaattcatgtctacatttccaaagcccatgttgttcccatgacacaaaattgtagcatgccttacacttattgacttgggagagttttttttcttaaaaatatagtatcaatataattttagcaaatcttactgccattagaaattggtaacatttatttgaggatagacttcaaaatctttatgagacataagaaaatgaagttccagaataacaggaatttgaatggtagttttcacctttcagaggatggttttttgggggtggtaagaaacatctaagtattggttctcatttgggggcatgcttagaggcatcagtagtttctggtaaagtaagggtctttcaaaagaaagacaaatgaatgatactgtataggtgcagttacatcataggcaccacaataaggtataaaagtaaagcattatgactttcaccttgggaaagaactttgaaatgaggaaaacaaaattgcccaataaaggtgatattttataaccaaccagtgtggactagtggagcataaagtttctttaaagacacaaaatagctgtagcttggattgcacatgtggatacatcaaaataaatatgtgtcaatcaaaagtaatatatgagagtttctgctttggcacattctaacttggtgttatcaaccatttacatttttcataagctaaatagtacgaaataatctcatacagtggttttaatttacagttttctaatgactagtgatgtggagcatctttttatatgtttatttatcatttgagttttctcttctgtgaactgacagtgcatatgttatgcaaatatccaaccttcaatgtccaattttgaagtcttctaatagatgtgaaatttgtgtatagattcttttgaactctacctagacaacatgggagagacggagatgcttaccaaacccattctcttcttcccaggcacacagttacagcgtgtttccccatctctcagttgttttgccatgtgacggactgaattctagaaaatgtaatgtggacagaaatattgctatacctattccataaaacttcccacaactgaaccttcattgtgttttaccatttaccagctggttggagaggatcaggatctaaagggggtcacaggtgagacgagtaatcatgtgaaaggctgcacaacagagaactcccacattggactataatttgaatgggaaattaatctattgggttaagccactgaaaatttgaagtttatctgccatagcagctaatattgtcattaactaatatacactatgtatcgttgtgaataatgactattttgtttcttcctttacaatctctatactgtttatttcccaggagttgacattttattatgttttgtttctttcttttcacttccccgccgtgtcacctaggaactctagttcaatgttgaataaaaaattttgaaagtggccatctgtgttttgttactgaatttcgagggtatgttgaagtttctcttttaagtggggttttcttttcttttttttagagtcaggggtctctctctgttgtccaggctggagtgcagtggtgtagttatagttcattgcagcctcaaactcctgggctcaagggatcttcctgcctcagcctcctgagtcactgggagtacaggcataagccaccattccttaagtaggtttttcatacataaacttaattaggctaagaaattttccttaaattcctagtttactaagaaaattttactgtaaatctgtattgaattttgtcagatgttcataggcttgtattaacatagtaatacatattttttggcctttaatctgttaatgtaatgaattacataacagacttttccaatgttaaactatcgtacattcctgggataaatccccttctgtttttacatattattgttgtctaatattttatataatagttggccaatataccaatgtttgctatactgcttttatatcactgttattggttatttttttcattcttgatttacatggccaatgttcatttggttttacttacatatttaccagtttctttactcactactgtctctttcttctcactttttcctttgagttcagctttcttatttctgaattacagtcttcacagttcttcagctaatagcaaagttttaaagtctttttctgacaatgccctttttcattcttattcttgaattttagatagctgggtataaatcctttgaagacactgaattctattctgaattgtattgttgttattgaaaggttcttcttcttcctcctcctcctgctcttcctcctcctcctgctcttcctccttctcttaggtaatatctttgtctttgtttcttctttagatattctctttgtctttgatgttctgtgtttcaccaaggatgcactgtgtaatggctctagttgtgagtttctttttatttaccctatttaggattcttgactttaatcaaatcaattaaagtgtacttttctcccattcttttaatattctctatgtggaattcttatgagacatagattaaacattacttctatgtctctttttaacatatctatatacctctctgtgaatatgcacacacatacacacatatataatatatatatttgtatatgaatattacatatattttgtgtatatattatagataaaagtatatatacatgtgtatttatatgcatattgcctgtgtatataaaattaatcatatgtaagtttaatttctatataaattatatataactttaatttatagttaatttaattatataaagattacatatatatatttgttgtgttttgtttttacttgcagtgccgagaattgaggtaatcatgttgctcagttcatggcacactattgttatcagtgggtgtactatttctcccttggttgtttgtttaatcattcctctttattctcatttcccacttatattttccttctcccataggaatctaatgtatttgttagaataagcaacagcacagtaccacagttgtataaattaaaatatatacccactaaagaacattatgtatttttaaagtacctatttctcactttctatattcagcattctgttttaaagatctatatatgttgctgtatatttatctagttcactgcttctaactgctgcatcttaatatataatgtgctgtcattgcatttccctgattcactcttcagtgctggaaactcagggaacttccaacttcctgctgtgcaaacaatgatcaaataaacattcttttacatgggttttatagacccttttgagaatttctctgggatgtattcctaggaattagattgattggtcattggatagacatatttgagccttatcctcttatattttgcatcttttgctgaatttgggatagtttcattaaattgatcttccagtttgtattttatatgttttaaattttctgtatattatgatgttttgacatcttaaaaaaccctttcttgctgtaaagagaccgcccttcctggctctagccaattcttagagatagcaaaggactcagttaggagcgtactttagatttgcaaattaaccaagttgtgtatcttctgtgtggcctgtacacccccagggaaaaatatgcttgtgtcttaatcatcccagggccatgtaccaggcaattagggactatctctatagtttagagcctgcagttattattcaaactaaccaattctaagaagtttatcctgccctccctcacgcttcctgtcccacggaagctccaataaaattctagttttggttttcctcttacttctgtcttctgccacctgaccaaaacctggtgattccccggtaactctgtatggcatgtggtacccccctctctagaacctgtgaaagtaataataaactttgttttcttgtggctttcctgtgtcccctgtgctgcacctgattaaccatcacctaaaagaactcagaatacgattcatacattttctcttcatctgcctctaatatgatatttttaaaatgtaaatgattagaagctctatttgaggataatagattgagaaaatgattgagcagaaaaagtaaatcaaatgagaatactaagacccttcaaaaaagatatggcagaaattcttcatgtgttttacaattttagaatgtaaactcataatttgttttgagttcatttgaaagaatcacatttgtaccagtcatgagttgatcagaaaaacggatcgtcatgaatgaaatagaatagtggatttaattagaccttgtacaattggggaactggttaagaagtccatgtcaggctgttgctttttcatgtggtatttactggacctggggtcactgtagataagctggaaggcaatcaggaatgagagttggatttgaaataggaaagggcaaggacaaactggaacccacaaggtcagacgggaaccccagaagacaaaatggagcccaccaggacaaactggaatttgactctgtctctcatgatctctaacttcaataatgttagtgacctgcagagaagtttgaacccttcatcctgaagttgcacatacacttggcccaggactgaaggaagtcaaagaaggaaatccactggaagctggagaactgtgggtctaggtgcttctcagtgtcaataaggtgggttaatagattagtgacaacatgtgcaaattgccaatgcctggtgtcatatattgagtttcagagtataaaatggtggcttcttcatttgtgcccttcagttcccagaccaatgtgctttatggcctactccaaattgagaaacacacaaagaaataaattctgagaatgtaattccagtttagctaggttgacatagtataaaaccatattacactagtttagttgaaggtatgtatctacggatatattttgtgtttatttcttttaccacccttgaagtatctccagctttggattaattttaatgtaaatttttcattttggagctttctagaccaatagccaaacttaaaatgagttacttgacagtggttctgggttctcaaggaagagtctctatttcgccattctgaacagaggctgagaagacaacttacccagttatttccctatacctatgggcatattagttcacacttacgctgttatttagagtggagtttctctaggttctagactctggtggtctctgttccaactccctataggagtagggacagacgaccttatctcctgcctcacagtggatattaagacatcagcctctagattacctaagacagcccttccccagagtagacaaagagtcagatctgggctttactgctgtgagtttcagttctctattattctctgtcccctgaagagctatttattttccttctagttcagaaatgcattaaaaattaaaaaaaaaaaatctagatttttcagatgtttttagttgacattttcaggctaactactctgccatgttacctgaacagggagtccattgcatttgcaaccaagaacttaaatgcagagacctcttttacaaggatagggtgctttagcaaattcagatttacaggaaagaaaattacaaatatacaaaacagatcaattagagggatgaatttgcataacaaaaggactcgccataggactagttaaaatagctaggatctaacagtgaatttagagcatctaggaaaatgtgcattgtataaatctatcaggcctgtagttaaagaaatgcggggatgaatccttttgtaaagcagaaagtcctttttgtaatgtgaatgagtactctctaatttacaagtctgtaagtttgagaagtttgagtctttgtgtatctggcttctcaaataatagagatccagaataagttatttatacagagagttcaggtttaactctcctgagtatgatttttctatgttaatataaaataatcaaaacaatctgcatatttaaagaatggaatcatgaggtccttcagacgtttaatatgtgcatttctacataatttcccatgggtcttgttactggaaatatgttgaagacaaatgtttccacaaaatgaccgatttcttttgatagatctatttaagcacacagtaaaaaacatcttgaccagaaacataattgctaattcactgtgttggacattagctattgagttattaaccagttatctgagggcctaccatgtgctgatcagagagtcagagttccttagatatcaggtacccaaactcttcattttccagatgaagaaactagtgatgtcaaatgacttgataaacagtttcatggctactcagaggactgcatgaaacttccagcatattatactgctttctttaatagagtgaaagagtccactaaattaaagaggttgtcaactccatggatgagaaatttatgttaaggaaccatgactcaccccgaagggtgccagactgagtctgtggcccagtgcaaagggcacagagacatgccatcagacaggcttgtgcctgcatgtcttgcattgacgttgggcaatttattaacttctctgaactgcagtttccccatatgcaaagcagaaaattaatactcatcctgccatcctgaaaatgtattgttagaaaagaacattattatatgggagatatactttactgtataaactccaaggtactttaaaaatgtcatttgttatgattattgccatagctactctagagaatgcatatatcaaaagatctatgaactttcacaaatatttttgcagaataatcaaggaacaagttgttaacctttttctcagaagcaataaacaagaaaaatctagactagatgtttatacaaaaagttatttacaattcagagctgtgtccaatgtcatttgttatcattattcttatatgagtgaattaaatattttttaaaaaattaatacatggaaagcaatcagaagaatgatttgcacacaacaaaatgtatatgaacattggttattgttaattatatcctcatacttttctattcctcctgcaattgtgcaagccaaactctctcaactctgaattttattttctattgtttgaaatgacaaagatcatgggtagctgataattcaagcattgtttttgctcaatgggaagactaagatgttgctttagggagtaaaagtatggggagacattgtaacaacagctatagtgtcaaaggacagtgtgtttttaaatgtatgtatacattatacatttattcccacttagcttctgttataaaagtcctgagacatcttctgggctttgatctgtttatggatccagatggcagagaggtgatgagaccacaggttagagagaaaatttagtcacaagattggaaattataagccttttactgcttaattattcccttcctgaatttcaggatatggtcacctatgaaggttattttacttcaatcaatccttggatgaagaagacaataaccatagctgtacaaaagaataatgagatttaagtattgcaccgatttttacctacattctctaattgctcattacctaaggcagctcagaaatgacgaactggctcctttttcatggtcaggacagctgcttttatatgttacatacttgtttaatatgaacttcaatggtttttagaagaaggaataattagaacaggtacagccaggggatttttataactcctttaatgaatactaaatagtattttatctttaaaagggaccatggctgcccttaactgcaaccaagttcattaataaaaagttttcatgcagcagacacaaaacaatataaagaaaccagagaaaaatctaaactgagagctgtagttactatctgtgctaagtgaatcaagcctacttgcaaagatgcataattattttttaataaaaaagaaataaaagattttgctggcttaaccaacgataggtaatgatactaaaaatgacatgagagtaggatgctgtatactgattccagctgcttctctttcgagttgggattatctgaattggaaaagaaaatccccatttccccagcaaggtacagattttacaaaacagagatccatccttgacatggtaaatatctaatgaaaccacctcttctttccatttttttcccaccctgagccacatgctgtatattaaataaaggactcaactttgttcgtactggagaagttgtctgggctgctgcaggatggaggtttacctgaggttacctgtatgaagggtgaattgctcacgctttagagcactgttatctttctccccatgtactccttcaacagcacaatctacagtgaagtacttgtcagggtaagcggtgaggaaagtgagagcaggttgatcaataaaacatagactggaggaagcctcttccacaggaaactaacaatgcataagaagcatattcttaacaatgtttggcaggaaactcagcagcatgaaatgtacttaatgtttaacagaagttctggaagaaggcagctttacacgtgacgtaaagaagattgactgaaggcatgctggggtctctatggaaagagatttggatgtgaatagacctgggcttgagccctggctccaccatgttctcaatgtgggaatgtgtgtgagttcctgctcctccccttcctctgctgtaaaatgggaatggtaacacctgccttaccagactataagcaaacagtgatctgagatgtgtgaaagctttgtcaactctaaagcactattaaaatgcttcaggaaagtagagggaatttatcctggtcacctgccttgggaacagtcacgaaaccataatgtgttcccagtcctgacactggcttccctctggctcaaaaactgggtcttgcaatgactggctttcttctgattttcaaggttgagtgactggcagtctgcctgggcacacgtcaaagagcaccaccacatcaactgcatggctgcagtccctgtgcaggcagcttcctttgctccccagcaagtgcaggggctggcagaggctgcttcagccttgtattgtagggggaaataggtgccacatgctgttatgaccatggtgatggtgggggcgactggtgcttctacataccctggttctaagctccttttctggatctttgtagttacacatgggagtcaacagcccactgccttccctttatcctctatctaccccattgccttcttccagcttccccccaacccccacccccgtctaatgaaaaagaagttaaattcctatcttagcatcaaatccagctgtagttttttctcccaactaagcacatgcagtacggtacctcctcctgtaccatatacctcctccagtaagatactcctgatctctttctcctcctctaggctcactttaaggtccttgttgtatgtgaccctatgtataccctgaatgtggttcttattgaactgtactataactgttaacttgctttcaattagaatgcgaactcttcaaaggaaattcttactcaccagttgtctctccatcatctagcatagtgcttggcatacagtaagtagatgtaaatgattatcgaactgaattgatcagaccctaccactcccattgatttaaaattatacatatgcaaagaagggtcattttgagaccacagtgcaatcaagatgaacatgtctctaacttctgacttctctctttctgaatccgtctaccctagctcacccatctgtctctgcaagaagggccaagaagagcacagactcagtcaaacaaagatggaacaaaattggtcacaacttgaactattccttctttattttccatttctgttttgaccctttaaaaggaatttcaaaattttactttcttctggtgctactaacgtaaaatgcctaataatctctacatggatacacgatttgaataattatacacttgatggggttataaggaaagtttggaaatcatcttacaccttctagacatattccaagtcaaattgattaaagaaattagttctttctccttagttctaaatcatatgccaggaattccaggtttgtggatttgtcatttaattgcatattattgataaatagtattaaagacctttcctgaggactcactgttctgagtggtttctatagctctgtgacagatgttaccagttggccagtaaaatccattccaatttcctctctcttgcttgttttctcctgcagagcctggaaaaagctaagacacactttcccagtctcctgcaagttggacggtggctgtgtgacatggtctggccaatgaggtgtaaacctgagtctgctggaaagatactggaagaacttttgatatcctgataaaaggaacacacatctctatcattgctccctttccccttcctccatctgggaatgcagatgtgatgacagaagctgccatagccactctgcagtcatgaggcaaaaaacacaaaagcatgaggacaaagtgccatcatgctaaggagagcacagcaaaaagacagaaaggctctggtcctaaatggcacagctaacaagtgcccatttccatgcctcttgccaaccaacacaattcatgtccttatgatttcaatccctggtggtcaggttttggtcacttgaagctaaaagcattcctaactgattcaaaccccaaataaaaacattgccctaatgatgaaacagaaattggttactttggcctcaattaaaaaatgaaatgtagctaatctttaacaaattcaatcctaaatagttctctttatgcctactgtcaggcaggcccttcttctgtggctggatctgatttcctaaagccttaatttctaactcaacatagcaaagaggtggagggaagccatcgtgcccaaaccctcatgggggtcatgacttacagttgactgaggatggcctccatttatcacatagtctattgcaacttgaggttcctttaacaaatactaggttataacatttaaagctgatatcacagcttctgttacaagaatattattgtactagtttcctaaggttgttgtataaattaccataaactgggtggcttgaaacagaaatttattctcttatagttctgggggccagaattctgaaatcagtgtgtcagcagggcattctccctctgaaggctcaaggggagaatccttccttgcttctttgagcttctggtggctccaggtgttccttggcttgtggcagcatcacgccaatcttcgtcttgtctttacatggccttctctgcttcctcttctcttttgtctgtcttcttttcttataaaaacacttgtttgacttagggcctatcctgttaatccaagatgatctgatcttggatcctaaatgaattagatttataaacactccttttccaaataaggtcacattcacaggttctacgtggacatatcttttggaatgccaccattcaatctactacaactctagaaaatttattccactttccttatttatttttgttgggtctcatgaactttgatttttttaagctgtgtgaggaaacatttatggcaatttaagttttgtgttgcatcagaatttaaggttgtttcaggaaacacgtgttttatttcacattttaaagtaaagaattatttctctgattacattttagtctttatttctcatgttaaagtaaaaaataggtgacttcagatcagtaagtatatcatggtagtgatattaaagagtatttactaggcttagtataactcaggcaaaacatttcttgcaaattattcaccataatctttgacataggctggattattagttttaaggcatgaattactttctacccaggtcaatggtttttaaccctgttacacattatagtcacctggtgaacctttaaaaatgcatgcccaggacccatttcaaccaatgaatgcaaatatgtggggatgagcttgtgcataaaagtctcctaagttattcttatgtatagtgaggattaaaaactgaccttgactcttattagcagttgccttattcaacaccatttatttattcaatcaagtaatcattatgcacttttaagtgtgtaagtagttgcagtacatataaggacatataagaaatgcaggtttataatttagtagtcatggtgtataatattttgtgtaatgtgccatttatactccagggtggtagagccaaatgcttatagagaccttctctgctggtcactcttaaaaattcaaatcaatttatagaagtaacttgtatcacaaaaaattagccaggcatggtgaagcatgcctgtaatcccagctactcaggaggctgaggcaggagaatcacttgaacccaggaggcagaggttgcagtgagccaagatcgcaccactgcactccagcctgggtgacagagtgagactccatctcaaaaaaaaaaaaagtaacttgtatcattattgctttaactcctctgcactcaggtgcgtgtgtgaacacacacacacattgctggtaataatcagagcaaaataagactcctatggttgactatcttcagattacaccctttacaaggtcaggagccttttaattattttagatcccccttccgcagagtagaaaccaatatatgcttgtaaaaactcacgactggtagtgatccctattagtagaaaaagcttgagcagtaaagttgcctgtgccctggagaagtgctgaggactagaaattcctctagcttccagctatttgggaagacccttgggtgttgagccaacattggcaggtgcgaaagggaatgacactggggctgaggagaggatctggcagccaattagcagcgcttgttagagctcaccccagactgctgtgtgactgctcattcagacattcatagacacccctgtcacaaataagccacccagagctctgtagtcgtacaaagcagcaataggagtggagaagaaccatgtttgtcaggaaggccctgcatgcaagagagcggcagggcagagagcagagtagagcttggaggctatagttgtaataagctttcaggaaaagagaactgagcaccttaattattttatttttttttttgacatggtcttggtctgtcacccaggctggagtgcaatggcacaatcactgctcatttgcagcctgatctcctgggcttaagcaatccttccacctcagcctcctgagtagctgggaccataggcgtgtgcaaccatgctcagctagtttttgcattttttgtagagacggggtttcgccatgttgcccaggctggtctcaaactcatggactcaagcaatccacctgccttggcctcccaaagtgctgggattacaggcatgagccactgcacctgacaagcaatttaatccgaggagtcatggagtcttatacatgtgaagtcttgttgatgaaagataggaagatggagaggagctggaggagaacatgatattaagccaagtatttaaaaactactgatgagctaggaatcaagctgagtgcattcattcatatgttaatcaaatactttttgaacatcttctatgtgtttcaggtgttgacagtgcagaggtgagcacgtgttctccagggtgaaggacactggaggagatttagggttataaaaacaaacagataacaaatgcacatatattcagagtaacatgatagaaatagatggtcaggagataccacctcagtttgggcgatgaggaaggccttgacccaaggaggtgacatgatgtgagctgagatgatgtggaaggtgttggggcttagaaaacaacaccccaaaatgaaggcctcagaagcagcctcagaagcaaaagtttttctctgaccttctcctgccctcctgtttctcagtcccattctctcctgaggctagctatagaaactaggatccctcttccccagggtgggtcatagaaaccagaccccttcttccccaaagccagccataaaatctaaaaatattactctaactttccctccacctttctatgtgaaaactggccacagagaaattatctgacttaccttgtttgactgtaggtcgtaatacccccattccagagagggtcttgcccaacacagagaaggaaggaatgcatgctcaggggggccaagaagaatctagacagacaggccttcctggctttcttcactcagtctattagcattagatcagaccctttttttggtccaataatatttcggcacagctgtccatactttgttgaaacgaagtgtaaaaatggacaatctccccagtatttttgggtcttcatcctgaaggctcccatgtttacatgctaaataaatttgtatgccttttctcttagtaatctgcttgaatgtgaattgatttttcagcaaacctttagagggccaagggcaactttcttcttggccccaacaaaggagaaggacggagatgcatgtaaagcggtccaggcagagggaagagcaactgtaatggccctgaggcaggaatatacttggagtttgcaaagaatcagatgatatccaggctagaatcagagtaagggcatgtctggaaaaagtggaaaaggcagcaggggttaatgataagcacgtggccatggctgggcttcgggaagggtgaggcttcaggtctttgtggtttggtctgaaagcgactgaggttccactgggtgagctgctcagggcacatcctgatgcagacagcctgttggctctgacagcagctctcccatcctcccagctgcaatgactgccgagttggctttgctttgagtattccaatcacacagggcctgcacctctctgcattccctgggggtgattttgatagtttctctgtgtgcacagtgattttgaggcaggagatacatgagcgactgcagcagcataagaagtcagtggtgtcaatgcctgacaactaccatgactgaaaaagttagattcctgaagtgacttcatttatattgccatatcctgacagaatctgaggccactcttggtatatgaacacagtatcatcttatatatatggaaataaaaaagaatgggaggtttttttttttcttaagcaaaaggaaaatattaactcaagacccaaactgttttattcatttgtggactcccacaataccttccttacacagttatttcactgattctagaacacacacttttcctcatttaccatctgtgaaatgataatgcatcttacaatccacagtgcctcacaattgccatcacatggttgtcatagcccatacccacatgcttggtcatagctgttcatgtgttgagtataattggcatttaaactgtgttcaaaatgattacattataatttggcatcagtacttggaaagatacaaatacagtagggagaggataatttgatatttgtgaagcaaataacttcactggagaagagactgcaatgacatatttcctttaaaagcagtaaccatgtgcattgtgggtctgaaggaaggaagatatccacaaatgcatgaggccttattatgctttgttactgcaatatatgaaaaagattacatgttacatgccaaggaactcaacaaaggcaggagtaattgacaaagccctctatatgaaggaaatgttcaatctgtgtgaggctgtgatgggtttatgtgttggacagaatcaccataaggctctgtgtcacagattaattggcagcacttgtttttcttttgtaggaatgcataacataatgatgcatcttataatagatggtatttctaggttccatgaaatagagtggaacaaagtagatgtttttgtcgttagactagggctatgcaaatactagacctcacttatcccatcacgttcaaaatgtctctgcagtttatttacatattaccaaagagctgtccacttgaaaacttatagtcagcattgtgtctcaagccaaggtaaaccaaactaaacattcttatggcaacatggccaggcgctgtggctcacgtctgtaatcccagcactttgggaggccgtggtgggcagatcacgaggtcaggagttcgagaccagcctggccaaaatagtgaaaccccatcttgactaaaaatacagaaaactagctgggtgtggtggcgggtccctgtaatcctagctactcgggaggctgaggcttgaacctgggaggcagaggttgcagtgagccgagatagcgctgctgcacaccagctggggcgacagagctctgtctcaaaaaaaaaaaaaattcttacagaaacttgatactcttggttggtgaactgaattttatcaaaagcatctatggcacacaggcagatgattgtagaatacatggccttaatgaaaaataagctaactgcttaggcgattatttcaaattcagtttaaggaagtcactgtgttttagcgtctgattttgaacatcaggactaaagaccctgaggcttttttcctttaaggtactatcaggtcagtgtgaaaaagctgtttgccaggggagccagttggaaatgaatgaaataatttacattcctgctgtgggcaagttgtcaatcattatgtgtgaagcctgtaccatcatttttctcctatatctacacaaggatgctgtcttaaggatgtagtcaagtgccgtgacaaatagcaggtcaatagctgaggacacgttgcctggtgtgtggtggtagagaaagggcacacctctattccccaaactccaggccggctgcttgatgtaatagcaggttgtaaagtgaaaaagcttctgcatgaaaggatagcctttacatggggtacagagcgcagaaacgttttttggccacacattggtttttctcagccatggatcataatgattatcagtagaatcatttgttttaaatgcagagaagagctgaaatgcttctatgtatcattgcttctggagatttctagaaatgtgtgctaggtagttcaatttaccatgtccaaatggaactcttgatttctccctccaaattttccctaacaaatattcccaatctcaagaaacctcaggccaaaaacatttccaccgatccttaattcctttgatttatctacaatcaatatcacattcatcatctctattttccttgtaaatcctgactcagatattctcaccttcttcaccacaccactttagtacaaggcaccaccatctcttgccccgactactaggtgaatgcctcagtaggttttcaatgacctccatccccattcccacagcagccaaagtgagcctttcaagcataaaccaaaccatatctctctcctgtttaacacccctctgatgctcatgctcacatttagattactatgcaacccctctccacagctcacaatacctgatcctgggccaccactgtgacatcttttctatcagccttttccctggctcatgctactacagccacactggcttccttgctggtcctcaaacaggcacggtcctgccgcaggggatctgcacttgccgctccctcagcctggagtgctgatctctgcatggcttcttcccacacttggttcagatctctgcctaaatgaaacctccttaaagaagtctttcctgatcaccctcctgaagatctggtcactgtctatcctcttaccctgctctatgtttccttatagtatgtgccactagctgatatcatattacagacttatctgttacctgcttattgtctttgtccagctctagaatgtaagttccataagagcaggagctctgttggttttgtttccaatgcatttctagagactagaacagtgcttggcatatagtaggtgttcagtaaatattttcattcaatataaatactacatatacttcttcatatgtcgtcttcccagttggacactttctaggcatactgggccctcacaaagatatatagagtgtggactacctttcaactgaagcattttaccggacatgccaactgatggcagcacccagggatggcaatgagatggtgtgtgcatcacccaagtggccctccacagtcaagtaggtcgctgaagtctgtctctgatgactttgcctcccacgtcttcctctgtgtctttctttcccattcctcccctggcagcaattcattcagtgggtatttttaagcacctgctttgtaaagggcattgtgtgaacatacagctgagccctccgaagtcaggtcttcaaggagtttggtgtctggtggagaggcgcgatgaacccacacaaatacaagggctggtaaaaggtgaagtgtcttgccccagtggaataaggaactagaaactgaaattggctcatctgactctgagtccagcctctcatccactctgctgccttgcagcccacccaagcctgccttccctctggcgctcctctgcagtttgtttgtttgtttgtttgtttatttatttattattatactttaagttttagggtatatgtgcacaatgcgcaggttagttacatatgtatacatgtgccatgctggtgcgctgcacccactaactcgtcctctgcagttttaatctttgttctaaatcctccttttccccttctctatattcaaagcaccaaatcctgcccttctaggtgaagttatacatcagctgatgatcagatcagactagttcacagtaagtgagaatgactcatagatttagttctctcaggtggcgtttgtattgtagtttgtctctgctgcagccagtcacaaggagatacatgtgtgggagtatctgtttctctatttttggggggactgcgggaaaaaggatgccacctggggtctgcttatttactgtaagtctttctaccttaccctgcctcttgggcttccataatgaagtaggtctggccatgggtctttctccttccttagtacaatttctaaagggaaggcaatattccatttttggcatttgggaggtggtgaaacaggcaccctctctgttctctctcactctttctctctctctatgtgcgtgtgcgtgtgtgtgtgtgtgtgtgtgtatagtggtactacagggtcatttataccagcacgcctcataagttgcacccctgttcgtcttgtgcaccatgtgccctccagtggctgccacgaagaagaaatggaacttcctaagtcagccatcctgacagacactgttggaaactttctctgcaaggctgagaacatgagggaaagactgcggatgttcattctgttgttaaacgtatctctgttgcaagaccagcctagtgtaccgcctttcatgacacaatacatctgtgaatataaaataacaggaactggtggcttttctcatcaaaatccaaccagttctcttcagacacttcttaacctgtaaaatgggaatggcaacagtgtgcatctcatagggttcaggtgaggggaaatatatcaggatatatgatgtatatatgacatatatgtcagacttagaacactctcacacaaaagtgtctttaggtcaatcaacaggtatttatttgccacctccggtgtgctagaaactgttctaggagctggggatacaggagtcaacaaaataatctatgccctgatggggctgattgtggttaataatcatgatagcaaaggcatagccaggatccaaatccccgcagtctagctccgagtccccagtctcctccatgactccatagcacctcttgttcactgagcaagagaatgcgaataatacacttgagatgacgttgtgagttgagagcctggacctcagggataaagacctgtacttggcagccatctactttgagtctgctagctgaaacctgtccaagaacataacactggggaaaggaggtttgagaaaaaattcttgagcaagattgacaattaacgaaggggaagataaaggaagagttactaaaacaaattcccattattgttactactattattccctgtgctcatctagaggagtcaagtaacctaaggaatcaaattcaatgaaaaaatattggttgcacacccactctgagcgaagagtggatgtgcaacaaatatttgagcaaggcacgaaaatgatttttcattagacagatactttgcaatttaattttctaaaatagctgagtttgatggtcaatgagttcaataaacaattttccagctttttatatatctagcaattccatgatcacacagtgtgtttatcatctatcattctccaattactgaatattggttggggttcctgtcccccagttttccatacatttaggcctccttgcatggtaccctatccaggtcatttttttccccccggtgagcccccattgatcatcttagattttctgagatggttttgatttcacatattttgagtgggggcttacaaacaataataagatcatccataattctaaaatctctcttcttttctctaattaaaacctttgtgggccaggcacattgactcatgcctgtaatcccagcactttgggatgcctacataggaggatcacttgagcccaggagttcacaacaagcctaggtaacataaggaaacaccgtctctacaaataataaaaataaattagtcaggtgtggtggtgtgcgcctagtcccagctacttgggaggctgagaagggagcactgcctgagcctggaaggttgaggatgcagtgaaacttgattgcaccactgcactctagcctgggtgacaagtgagaccctgtctcgaaacaacaacaacaaaacaaaacaaaacaaaataaaacaaaaaaacccataaaacaccaaaataaaacaacccccccaaaatctctggggtgcactgattgcagtaatggtcccatttcttcacccttccctactctcaagctatttaccgtgtgattttgcagttgctcctattgagaggtgaactatatcctcccctcccaagctgattttgagttttccatatagcttcctttggccaagtgttggcagatgtgatgtaagtagaggtgtaaaaaagcgcttgctcatttttgtttgtttgtttctttctttgttatgaagacatgtctgcgatagcatactagagagtggggcacagggagtcccagctgtttcagctgagaccaccccaggtcagtcaactctcatatgccagaagactagagccaactgccagatgtgagggagccagatgagatcagaagaaatttgcagccaagcccagcctaaatcgctgacccacaaactgtaagctcagctaaacaaatgtctatcgctttaagccacttcattttcagacagcttgttccatagcattgttgaggcaatggataactgataatgcttcccataaatcttaggaacttggaagctgcccctccatttgccctcctttaagcaaaaaattgaatgctatttgcaaagcattgtataaaatgctttattagattatcttattgaatcctgacaacaatatctagcagacagatataatgctattatccaaatttcagaggcaaggaaattgaagcttagagaagtttaagtgacttgaccaaagtgcttttagaaaagcagagattctacaaccagtcttctaaatcttggaagactgcttttagccacggctgcctgccatttactctttggattctccattctacctgttctgctgcctacttctaccacctaattaggagaagaccttgtgttcccatttgggatatagatacccactttcatactgggtttacccctaatatttctctccataccactcatgtagatggttgtcttccgcattaatctggaaattttttgagggtaaagactaaaatacttatatttttatccccacaactctatgcagtatttttttaaaaaagatcatagtcatgttttaaggtagctattccataaaacatataaaaaggtaaaaaatactctcctagagaatatatgcatatttaaaaggacactgttattcaaattaatctaatttgtggaatacacagtagagggttttccccattttgttaaatagttttagttatatgttatttgaatgtagtgtttgcctgaatatctacaaaaataaaactctcttgactcatttatagattaattccagaagcagggattaatacaaaactggcagtgaataatttctgttttgcagttagtttctgcatttaagaaattgctttagggttcagtaacttgccctggacttcaggtatgctgccaccagatggcagcagggtgccaggcataaggcttgtaagcaaagaatttgtgtgctttctgaggctcaaggtaatagctctttccttaagttcaaaaagattttcagaccactgatttccaatttagcataatacatttctttacaaaaataggtaaactaaaactctaagccaccctaagacatctttagaacagatataaatcccaagctataaaatcacctaactcattattacttctcttctctagcatctaattatttctgtaatggcttatacaccatgatggcttatacgaatcttatacacctacctcagtgatagtgttaaccattataatttactttgaatctttatgatcaatctctgccatggcaccgtgtatgttagttttcaaaattctcaatagtttttctccaggtaaaaaaaatctatctggctttcctttcatctgtcttaagagagcagaggtttatcttttcagtattatctgagatcttctcttaagaccaaaagtatttctccactacagtggcatgaacagtgtttatttgcatttcgtgtatgtatttgtgaatatggagtacttttgcttttgtattttctatactatataataatctactagaatatttcccctctcaaagctcttggaagcacagaggcagtttaccatactttaacagaaatatagctggattaaaattttttttttttagcaacaggctctgccctaaatatctcaagaaaatactttaaagaacaaaaatcttcatgccaaattagcaagatacaggaaaaaaggtaagtgggcaaaatacagggaaaaaaagctaattcaccctgacagttgttacacaaagctgagagagtctttccctctcacatttacaaagtccaggagcggaaagactttcagcaggagtaagccatgagggtttggacaaggctggtaggggaaaatgttatctcctgggcatactgggaagctgagagtccagggcaggtgaatggggttggagatgggaatgagggaggacagcatctgagcagtaaatcctggaactagagttagcatatcaagcagggctatctatgcacccaaggtaagttctggctgggagaagcagatggcaactaagctgtgaaaataggctccaagggaccagctcccagcgtaactctgggggagggatctggggaagtacaaaaaacatagagaggcaaaagacaaataaaataggaggagaagagaaagggatggatcatagaaagctcttatttgattttgagtctcacaggaaacccatgaagccagcagggcaggtattttttatcctctatttacaaatgagaaactgagtcccagagggggtaagtgactttttttaaggtcaacataccgaggggcggatataagattcaaagtcaagtgacctgattccaagctaaagatgaaagaagagagggcacatttgaaaccctgacacacacactgtatgtcctactctttgctttataaacagtaagtaaaattttcaaataatggaagcttagtcttttaagggtcaaacggaagcagctttagccactgttgaaaagcatttctgaaatgtattatatttgcccttgcctcctttgaaaactgactgtaatctactctcttcttgatacatgggttataattacaaaaatttactatatttatgaacttctaattcagtagataccctcaggttctatggaggcacatgtgttttttaaaaaattaattttttttgctgccccacctaatacattcatggctagaaatagctgtgtagcagaactggctgagtcagctccttcttccctcacagccagctcttccttcttaagtgtgtctgctgctggtccctatctactgcttctgatcaggtcattccgcttattaaaatcctttagtgactccctctaaccactggttgcagtagtttgcaaaacaggctgcacatgaaaatcacttgaggagcttttaagacctcctgatacccaggtgccaacacgaaagatttcaattcaattgttttagatatggggccctcacctacagggattaacataagtagcatgaactcttgcttctggccaagatggaataacgggggctagatttatctttccaatggacacaactaaaagtccagatgaatatattaaacaatggttttcaaggcaacgggcatgaggcattgaaggacagtgatccctgagagatggaaaacaaacaaaatgagttgcatttgcctgcaattgcccctgagagaatttctaggccatgcagcagaaaggaagaattcagaaggagtctgcaagactccttaaatagaaaagatgaagcagagaatccaggtagactagcgtggctagagtttgccaggcagagtattagagagcagggagttctgatcagtacatgcatgtgaggaaatggtataaaatcaaatgaaaaaccagctgaaaagatgagtaggaatagtctttaaagttcaaactggactggtaaaactgagatttgaaaactattcaaattgggaagccctgaaattcaaagagcattggtcaagtactcagaagggtattgccctcgtggtggggaagtattgtcaatagactaaacaatactctgccttgcctaaccttaaaagcaagacctgaaagatcaaagactattcaaagaattttcctgtatcccagagcaatacccaaaaatatctgtaggaataaaaaaaaaatccagcatccaacaaggtaaaattcataatgtctggcgtgtaataaaaattaccagacatgcaaaaaaacagcaaggagaaaaatcaataaaacccaaacctaaactgacacaggtgttacaattagaagacaaagatattaaaccagtaactgtaactgtattccatatgttccacaagttggaggaaacagcatgtttaatagagacagaaaatataagaaagacccaagtctggccgggtgcggtggctcatgcctgtaatcccagcactttgggaggccgaggcaggcggatcacaaggtcaggagatggagaccatcctggctaacacgctgaaaccccgtctctactaaaaatacaaaaaattagctgagtaaggtggtgggcacctgtagtcccagctacttggaaggctgaggcagaagaatggtgtgaacccaggaggtggagcttgcagtgagcagagattgcagagattgtgccactgcactccagcctgggcaacagagcgagactctgtcttaaaaaaaaagaaaaaaaaaagaaaaagaaagacccaagtctaacttgtgaagatgaaaactataatgtccgagataaaaaatacactgcatagtaacagtgacagattagctattctaagaagaaaagatgagtgaacttaaagacatagcaatagaaacaatccaaatgtgtcacagagagaaaaaagactgaaaaaaaatgaataggacattggtgaactgtagtacaactttaaatgacctaatactgatgtatttggggtttccaaatgagaggagaaataaggtgagtaatagaaaatattctgaggccagatatggtggcttacaactgtaatcccagcactttgggaggccaaggcaggtggatcacttgaggtcaggagttcaagaccagcctggccaacatggtgaaaccctatctccactaaaaatacaaaaattagccagatgtggtgtcgcatgcctgcagtcccagctacttgagaggctgaggcaggagaatcgcttgaacctgggaggcggaggttgcagtgagctgagattgtgccactgcactccagcctggatgagagaataagactctgtctcagaaaaacaaaaaaatttaagagataatgactaaaaaatttccaaagttgatgacaatgataagtctcatatttaagaagctcaaaaaacttcgcacatagaaaacatgcaaaaaatgataccaatgtgtgtaataatcaaattgctgtaaaccagtgaaaaagacaacaccttcagtgcagccagggggaaaaaaactgacccattatgtatagaggaacaacaaaatggcggcaggtttcttgttagaaataaagcagaagagaggctggtggagcaatatctttaaagtactgttcgttagaattctatacccagcaaaactatgtttcatgaatgaaggcaaaatgaagtatttttcagacatacaaaagctgtgaaaatttatcactagcagcctcacactatagaataatgtcaaagacagtccttcaggtagaaggaaaatgacaccagatggaactaagggtctacataaaggaatgaagagcttggttggcttcaagggtgtgtgacctgtatggttacacaaggtcctgcagatagaagggccttgtgctagctttaatgttttgatgttactggctaaaaatttttaataatttttgaacaaggggccctatattttcattttgcactggtagctggtcctgatgaagaatacttagtagtccatagaggtggaggcagaggctggaatgccgagcttggctctgaagatccaggccatatgttcaggcatggaatagggaagagatggaggtggcttcttcagaggaaatttggaatgttttaattttaatcacgagaagggtgaatgaacagatgtccactaaaataaaaattttaaggtagcaatttctgggtaattagaacacaattttcctttctgcacagagatagatcataaatggctataattagagagtttcagttttttctgaagttcatttgttgcggagtgttcaaaactgtctcttcaggccaaaatgccttgtttattgtgtgtgtgttttactatttctgatatcaatgctttaataatgcctgttctgtaatattggcccagaggtactgcaagagtgtaaattcactttacatgaaaaagaaaagctatattacttccaatgacattttagtgattaaatgcattttatttgtagtataattctatcccagtttaggtcaaagctccgaagttgagagtagtataataagtgtggacatgcaaaagatgctgaaaggtagtagaaataataatgtcagatctagcccatcaccaccctccagaacatatatgaaaggattagaaatcaatgttaagtgtgtatttatttgggagactgtccatcctaaatgaggacaaatgtcagggtgcttttcccaaaacttgggctggctgagggaagcttcaagagaatccctggaacagcttgaaatctggatgcagggggtggagttggtagagtccagaagctttacctgatatatgcctggaaaagtctaaagctcagaggtggtatctagctgtcctgaaggcttgtggggagccagctgtactgtatataggtataaatgcaatgcttaaatccacagataatttataaagttcactctacacttgaatactcacatccagtcatttagttgaagccttcggctttgattaaagttgttaatatttgaagtgctgactgatgtaacctccctggtatggaaatatgaatatttctcatttattatgtcccgtggtgaaagcataaccttttacttaaaataattggtttgaaaatggaattagaatattcatcctccccattcctcccctgcaatttgtgaatttagtaattattcttcttggttatgagcataagttaccatttacctttattcaatatgtacacacgcacacacacacacacacccacacactctcacagaatgcaaaaaaaaaattaggaaataaagttatcgcaactttagcaatgagagcggggtagacagaagtgtgagtttataatgctgatcatgaaataaaaacttcaaagcaagcctaaatctgatactcataggatgatagctctactgcatttaaagcaaataaagttacatttctcaagaattaatgcaaaattagaaagtttcctttgaaaatctcttagcacatctccaagtggttagctttcctgggaaagctggaaattaaatcaacaacattgaaagaaaaaaaacctcacagtcctaaattaaacagtcatgtaaatatagtttccaaagctattaggcaagaagcaaatgattttctaatcaatttactgttgcaaaaataatgccagattattttcatggggcatgtgaaataatttacatgggacacacgtggatattgctaccttagcaatcttatctagttctacccaaaggtatttaaaaaacaaccactgacgctgaagttatttgtaatcatatcagcagcctatctcctcatcctccattctcttcccctccaccagctgacttttgtatcaaaggcaggctacccttgcacttctcttttcacttaacatagaacaacagttactggagcaatctggttcccttaaaactagcgactcattacaatggttcaggatgtgaacttccctaaaaggctttgctctaaatcaaggtgactgtacattcccttttaggctagaaaacaacaaactatgcattcttagtataggattattcagcccatatattatatgagactacctcatatttgggtacctctctcattagttgggataaacaagtcttgaatttgagataattcaaaatctttgtaagccaaaggcatgcacacattttgcctttttctcattttaaaacccagtaacccaaaaccatcacatgaactacccaattctattgggcatacaaattttgttttctgatttccaagtctgaaggttcaggtcaatatttgtccgtaattaacatggacataattaatctgctgagttaaatgacatacaaatcctcaccaccaagagtgtgaacttgcccataaagttgtcacacagaaaattgaattcaatcagcttactttaaggaaaatatactgagttagtggtagacacagatggcatgcttcagaggattttggccttaaggtctaagagacagtgactatgttttcaaattttgacacaatgcttgtgacaggcacttctccctgtattgaagccagaaaactgttaagagccaacatgggtggaaaagaccagttttctttttttctttttctttttttttttttttttttgagacagagtcttgctcagtcacccaggctggagtgcagtggcgcgatctctgctcactgcaagctctgcctcctgggttcatgccattctcctgcctcagcctcccgagtagctgggactacaggtgcccgccaccacgcccggctaatttttttttttttgtatttttcatagaggcagggtttcaccatgttagccaggatggtctgatctcctgatgttgtgatccgcccgcctcgacctcccaaagtgctgggattaccggcgtgaaccaccacgcctgactagaaaagactaattttctgtctcaagtcaaggctgattggcctcatgggtggtggtggatcagtccctaagccccggcagtaaagccaggggccgtgatccccatagtcactgcagctgtctacaaggtctggctgcagtcactaaacaaggatctctaggccacaggtacccccggcactggggaaagtgagtgcccaagcttacatcttaaacactagttcaggcctttggattttgagagacatagagcctcacattgtaagtgatccttacttcagtgaaaacatataatagagtcctattgaaatccattctttacaatgggagattactgctaatgctagctaggtgagtgattcatgtgctacctattgtaagtattaattcttcattaggtagcagtgtgattcagaaaatgttacatagggatatttttcaagctattccattaactaattaactgggatgcaacttaagttggaagattgtttggttgatgtatggaaggtacccctttaaaaaatatctatgagtagccatgtgatgagtgtcaagttcttgacagagaattgaaatcttagcctgctgcgaccaaaaagcaatactgtttcagttagttccgttgccacacagactgaatgaaattaaccaaaggctttatgttagacaatgagtctcttctgaaataatgatagcttttgtgagggcataagaagcagaaagttaagaaagagttacttatggccatacaatcacattaatttgtctatttaatgtgacttttagattcaagaacaatttctatacgatgttctagaaaagacattattttttcagaaagacttttaaaagcaaggaattaattagttactaataataaccatcatttaaaataagcaatggcatgtaatgtgtagaaccgggacttttggcgagaaagtgacataaagagtagaacagagcacttttgaaccagcagaaacttatttgctttatctcttagttcataaatgccattttcctcaatcatttactataaaactaaaactattctttaaaaacctaagtgatttctcattgttactgttaaaaagaaatgtgtgctatgccaaatacaattcaaatgaatgaccattttatgttacattttcatcttattccttcatttatgctagaaaataacaaaagtaaaaatgcaatgagaaaagtatcaaagtcatgtatgcagattcagttgatctctttgggcttgactatttggcaacatatgttggccagtttttataggaaatctatgctaagtgtatgaataaaacagagacaacgtaagattagacactagcttcagaaaataaaattttgataatacagcagcctatttagtaagaataaaagcagtctcttggagtgtgggatttgtatatgtgattaagaaatagagacaaggggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaagaaatagagacaaggaaacatgatagagatagaaaactaaaaaaatgataatttaaatctttaacagtgaatatgagcaaagatcagaataggaacctatttattatcatatctatatcctataactgaaaaaatttcctaaaaaggagaacacaaaaatgcttggaagattttcttggataatgcaaaataccctgggagttctctctttacctcttagttcccccacatttaaacttcaaaagacaatgactctggagcttgagagagatcgatatttaaaacagaaggcatatctataaatccccattggatgtccaaacacttataaaaaaagaaaattaaatttcatttatcaagggttgaatagttaaggtgtcactaagagaccaacttacattaataagttcaacctcccagatttttttcaacaggtccatcgaagtgtagccattaattagaaaggctttggtgtagtcgcccagttcaatggaatccagccactcagctacagaggtgggatggtagccatcatgcccaatgggtctcatctgtaataaagaaaattacattaggattaaactgtatactttgtgtcccaacaacagaatgcagatttccccttgaaaatttatttgacatgaagaacagatctttctggagacggaaacaaggaaaaagaaaacactttctgatgtgttttcacaattctaaaacattaataattttcacgctgaataggttttcaaaatatacacagaaatttccaatttagctgctagattaactctatatttggaagagctaaacatgtcaaacttctgtcatagacattattggcattctggtgggtggaattaaaaatgatgtcagttgaatggcattaaattcgatgcgaaagtcaccaggaagtgcactttcaacatgtagatgataattctcatatgcacagcaccaaagcatgtgaaaatactgcatgacttaagcattcaaagggaatttgtgcttatgcaagacatgtattggaggtagtgcaaacacgctggagaaacatactgctgcggtgaaccagtaaaggagaggcctttgggtattttaagaccatgtgttctgcatcgactctacagtatgttagacatgaatagagaacttgctggcagacaggcatctattttttgtcagctatatacagatttttaaaaaataggagaacaaagaaatgtgacagcaacataatgtttctgagtttaaattggagtgtgaaagtaatttaagcaagaggaacttctgggtttaaaattttgtatggattattctggtcctttagcttttatttgaaattgtagctgaatctgtggttcttggttttcgaagtgactcacttctaaaacttgggctgctttgcatgccacgccgtatatctaatacttcagtttttcaggagagctggcacctcatcaacctgatgggggccttcggtaaaattcacgatggaaacagcaaggctgggcaaaacacaacatagattttcctctttctttgattcaaagagataaatattaatggaaatttatatgattctgatttgcgagcagagaaaagattagtctgggaatcagggattcagattttaatcttaaacatggtaagctttctatcactatgcatggttctcatttttgagattctccctactccttcattttaaagttactttttctcttttccagttgttccgctccccattctagtttccatttcaaagtttaaatgttctctgttttattttattttttttgaaatggagtcttgctctattgcccaggctggagtgcagtggtgtgatctcagctcactgcaacctccacctcctgggttcaagcaattctcattcctcagcctcccgagtagctggaactacaggtgagtgtcaccaagcctggctaatttttgtatgtgtctctactaagagacagagtttcaccatgttggccaggctggtctcaaactcctgacctcaagtgattcacctgccttggcttcctcccaaagtgctgggattacaggcatgagccactgctcctggcctaaatgttctctattttaaagttagagtacaatttattatttacattagagtctgaacttggtcagacttttgtacttcacttttacattgactgacccattttagctactcattaaatatttgttcatgtaacacttaactctgtgtttattatgtggtagctacaaatgtaaatgacaactcagcatttgcagaatgaaagtcagtggcattcacaaatccctggatgttatgtatgtataagatcagaggctaggacccaaaagggaggctcatagatattcggtagcttcatattctatagagaattacaaaaatattggggctgggtacattctccaggcctcgttaaaaggtggttgaactaactctgttaacctaaataatcactctggccccaggaatcttcctgactgccccagtgacatgaaataagaaagaaagggaagaaagtgagaaacactaaggttgaagttaactgcttagtagggaggtcttgccgttggcccatccataaagctgaccactccagcagcagatactcgggaaaagcttagggagtcttgatgactggatttgggtcaaagtcagttgtctcataccagtgaactgtgcaatggggttaccacaggttacccccaagcacttacacaacactcttttgaggaagcaattagtggccatctgacacacagagggtgttgatggtcggtggtggccaaagaatcagggaacccatgacaggactgcaaagaaaatctaggtaagtacaaagatgtttgcttgtccctccaatccccctttcttgtcccaatgccagaaaatttagaatcagaagagagaagtgccagtcccttaggggaagtctaaacttgggggggggggaggtggtgaggaaaataaaactggaggtttcaaataaattggaactgagccttcaacattttacatggttggaaagttattggaaatgtctgagatgatatttataaatagtaaagggagggtcagttgagcttggttgaatgattggaaaataaaaaaataaaataaaacagcaaccatcatatcaggattgcacggaatgcaggctgttcagtggtctgattactcctgtaaggcaagttctcctagaccaatcttaaagaggtgagagggagggaaatatttggtgggaggatgaaagacaagggcagggtagagagcacaactgaagagaccttggaaatgggtatgctgaggtgtacagggcagtatcatccgcccactcattcaataaatatttaatcaatgcctattctgatgaatgttgtggaaatggtagagaacaaaacagtcatagtctctccctcatggagattataactcttaattaaaatatgcaaacagatgaccaataaattatgaaggttctgcatacctgaagagaggaaaccattagagccaaatgcagttacaaaattaacttgacacatatttaatgatatgcagaatagttactgtgctgcacaataatttcttccaaagcaatgatcccatctgttcctttatttctgtccctactgccattaccctgtttaggttcttgttagtgcttacaaaaactaacacaatagccttctacatggtctcccacctttgatccagcttgtatcttgctactacattagtcttcctaaaagtcagacccttaagtgtacctttgtataaaagcctgtagtggctccttctcgaaaaaagtccaaatgtcctattccagcattcaaggccgattgagattagcctaatctcccactcctctgctattgtgtacccaataaatgtaactagacacgtgtatgtctaaacagtacattaaatcgctaggcattccctgaaaatgacctgtatatgacacagtcaatatctttgctaatataacttcccatgcttggaatgcttttgcccctgcttctggagtgatttcttcaggactggcttctcttcttgagctctgagatgcaaatttctaaccatttgtaggacatctcacataaatgtcctataggtgtcaccaacataagtcaaaaacaaatttaactcctttagttcaaaaacaggctctcttcctctttttttccatttcagttaagggcaactattactccactgcccaagcagaagcttgggagttatcttactttcctctttctgtttactatcatatctaattaggccaacatggtctatcaatttgatttctaagatgactctcaattcatttctcttcttccaaaatggactttggaatatgacattcccagcagtgctacgtatttgttgggtgatctttggcaagttactctttcagcctgtttcctcttttttagaataagcataataatacctattccaagtgttgttgtaaagattatatgaaatagggaataaaaattgcctagcacagtgatttgaatataatagctattcaattataactcttagttctcttttctccccattgccctaaattagacccatgcttattttgaaattgcataatattctgccattggctgctagtcttttcagcttccaatcaaagctctcctctctcatcccttcctatttcctctatttccttccttctttatcttgttttagaaatggtttgcatctgctaacatctttacccctctccccttcagccgacagttattttttagaaacatatctaacgaggtcactcaagtcgattgaactgtttattccaattcttcgttctcttactgtattagaattatgcccctgtgccctttgccaagggatcaacattatgtctcagtgtggctggagttacttcccagtctcatcaatgctggccaatagaatgcgtgaagtgtcagtgtggtggttagagacgaggtctctgtgctcctgtgttctactaatctttcagtgttcatatgctctctcataagaatagcaagtgctgagaagttgcataactcctggttctaggagaaagatgaagactcgtggagcaaacctaaatttaacccaaagcttggaatctaccctagctcgatggggctcaggaaagtccagatgaagttagctgaagcacagcagacccgtgagtaagaaaaaaatattttttgttgttgttgctgtgaactactgaaattttgattacagggaaaaactgaatagtcactccttgtttaaaaacccttggtgtttatccattatgcctgtggaatataaatcagaccttttagtttatgaatctattggcaaatgcatcttcatgagactgagaaagattagggatgctgaataagcaaacatcagtatccttcccaagctacctcactgtcatgcagaaactctgcatgccacatcttttttttttttttttttttttaagacagagtctcactctgtcacccgggcacccaggctggaatgcagtggtgcaatcttggctcactgcagcctccgcctcctaggttcaagcaatcctcccacctcggcttccctagtagctgggaccacaggtgtgcaccactacacccggctaattttcttttgtatttttagttgagaccagggtttcaccgtgttgcccaggctggtctcaaactcctgagctcaagcgatctgcctgcctcaacctcccaaagtgttgggattacaggcacaagccactgcccctgccctatatgctgcctctttattaaccctaaactaagtaattctttattgtatgagtttgatttttggggcataatccactgtacatgtaatatacctccacatcttcgctcatgccattccctctgctaggaatacagtttctactttttctcctaatgaaattctatctatccttttttttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaattctatctatccttaaaaggtcctgtttaaacgttacctcctgtgtgaatctttctctaatgttaccattattccaccgaaaaatcatatcttctgctatatttctgtagtattttccatagagttctattatagtattattaaagtctgctttcaataatagagaagtgagtatctgtcttcttcattggactgcctaccccttggtgaagaaatgaggtgttaatcatttttgaagtccctaaatcgtccagcagagcatctcacatatggcaagcatatgctaaatgtttgttaaattaagtgacttaatgaatacatgaagacaaaatgacaaattcatttcagtggcttggtatccatttgtgggagagatttgtattttgtactccatgttatgaaaactaaggttatctttttctgcctaacaataacattcataactatttaaaacctccatatatcaagaaccagttccagataggatattgtgttacagaatgcaatggactttgtttccatagcacagaagacttgattctattagccatgtagccatgggcaagtcacttcatctctctaagcttcagtggtgtcagctataaaatgaaggtattggaccaaggatctcaaagctgctttgtaattcctaaattttgcaattccatgactcgtaaattaattttaaattagtaacctatttgtttacccaggaaagaaaaaataagcccaaagacaaaactaaaattcatatatatatatatatatgataggacgtgtagactaaaggtcagatggcattcacatttctttcatgtatcttcagcagtacccacagggagcactgtgactgcattctcaaattagcaatgatgaaactttttttccagcgggaacatctggcaagacagggctaggaagtgacagctccatcggcctgccaggccagcagtgctgctaagcatgaacggaagtcaggctcactctataatctgagaggcagagtggtgagcaggcagcaggcattcattacagaggctcgcaacaaggcaatttgattcaattagttgaattccaaagtctggaaaaacctaagctgagacagaaattcgagatagcagtgaagctttagtcttgggaaaattgagatatattaacatattttttttttgccaaatgccttccttgttcttgttccacccaaatgactttcctccaggagttttttagagcatacttggcctcagagagagtatgctgttaacatcacaggtggtacagcaggcagagaaaccacaggacagtactctgtggagttctgggtttgagggggtcagctacggggcagctgaacaacccatgctctgagactgcttgatcgacttcaaccagagtaactcttattttatgcgttttatacaagtaagaggaagaaaggttttctcggctttaaaaagaaatgtttgaaaaccacgaatctagaagacttttgtaagattacatgaccactatgattttattttctcttaactttttagctttatttgaaatattatggatctgttatatatatgtggttatatatatatatacacacatatacatatatacacatcacacacacacacacacacacacacacacacacacacacacacacacatatatatagagagagagagcctgtcattccatcattctttctctttgcctgaagccagcattttctgtgcagataaggataatatcttatgagatgacggagccacaggatggaaggtatagcaggaggaaggcaataaaaacaggtaaaaaaaataaaaagagagagaaaggtgatatacattataatagctttgggattaaatgagaaaagtagttcttgatgggacaacttattaacctagaattatgatattggcatggtatttagaacaagaggataaggaaccctgaaaagccaataatggattagacaggcatttttatgtccaaaagtgttagaaaattgagaaaaagactacttgttgttcccttaaacttgtcctctcttcttccacataatggggttaaattgggttcatgcctgccggactagagacaagatacatcagctttttttctggttgctgctgtgaaaatatggttgagcctgtggaatgctaatgaaagtgttgcatgtaactttcaggtcacctctagctaaaagaagttcctcgacctagaattcctcttttttcttcatcttcctataagctggaacatcagtgactgcagttcagctttgactacacaggcaaaacaataccctggagtctgggaaatgcttctcagacctcaacgtgcttaggaatcatgcagagaatcttattagcagacgattctaattccgttatttggagggaggattggagattctgcatttctaaccagcttcctggtgatgctaatgctgtcagcccatgaaccacactttgagtagtagtgctttggaggatgacagaacaacaaatagaaggtcctcggtccttccacaattgcatagagcaaagccaccttgtaaacctgcactgctcatttcaagactattatatgagagaaattaatattcgattctttaaaccactatattatgaatgtctctatttcagtatcatagcctttccttgaatacaaacataactaaaaataaggcagtttcatgtagaacatttaaatgaagcctgtacttccatttgacattacattgtattatctcttgttttgtggggccgtaagttttcacatctgttatcgttaaagaagcttcatttcctttaactgtgtttgttggcatttctctgtcaatcacagcatcatccctttgtaacaactatgcaagggataagaggagaaaaatgcagggaaaccccaagtttctagcttggatatctgggcaaatggtggtgttaccaggtaaaagagaaaagaaaatagactgggatgacatgaataattttgagacatgagaaatttaagatgctatgctgtggaatggcactttaaatttggagaagtctggggagacacgcggccttgggcatcatcaaagtacaggtaagagtgttggcaactccacttattagctatctgacctcgagcaaatcactcatacttcctaagcatccattttctgattagtaatgtgaaagattaaaagaatatctatcgctgagcgttgccatatgtattcaatgaaactacacaaggagaatttagcacaatacttggcacacagaagcactcaataaatctttgttattttttttctgacagctgaaatcatgcacaggtaggactgcagaggtgactttgtagtgtgagaagagaagtggcctgagaatgaaccaacactttcaatgcataaggaacagataaaaataatactcaggagaccaaagaaggaatggtcaggacaagaaaagaaatgggggaaataagagtgtcaaggagagtgtggtcagcagtgaggggatgctgcagagacgtctaataaaatgatgaaggagaagggtttgtgggatcacaaataggtcatcggaaataggtcaccagacaccttattgagaagagcacagaagctgagctgccctaggttggggagtttgtatgggaagaaaagggggagatgagattttagaaagcacagaggaaaacacatggaaaggggtaaagaaatgaggactcagggttgagaagggtcagagtcataaaacagttaagttccagggtgcagtggagattgcaggggagggcttgccttttgctttgacactttgccctcctttcttgaaattacggatctgacaaggatggttggagctaacttcagggtgaatactctgtgttaaaacagtgcgagtgtttggaagctacatggtttagacttggtgagagctggatgcttgtacgtgaagtacctgtgaccttctggtgaaggtcctcacgtgggcaagagctgtcgcctgtgttgtcttcactcctcagatacaaacacagcaacctatcatttacatagacccaccagtgccgatatccctgatgtgccaggctcagctacttaaacttgcctaggaagctgccgtggaccgtggcttctcttttcccacctggatgtactttgtacactcagatttcctgcctgatatggcttttgtaatacagatagctgatatcgtcaggtacttccctctattctggctccttgttctagactcttctgctctgtcctgctgctacccaagtcttggactaacagcagtcctgaaaataaacgaggacaagcagtgctagcagacagtgtgctgccaagtccaaatgcaggtctatcaagtagtgtgaggatcaaatctacaggctgtgagacctgggcttagacatcactgtgctgtttcatcagtggctcttaaaaggctgattgaacataaaagagaaaggctgatcttctgaccacgaggccccagaaaaaagtctacctatcaccatctgagtgctatctacggcagtgcaactttgctgggagggacgtctccaaaatgctgagcactgttaatgataagaacatcacttaacaatgatgtgggactttaaagagcctcaagtgatttcacgcatgtcacctcagttgtaaagtgttttaggtgatctttaggaagacaccctttaaggagtctgagagcctgagtatcccatataattatattccttctgtgggaatggaaaggattaatatactgtgactgttgttggaaagcaaggagtgataaactctctgtgttgtgcatctgtagcaagggaggtatacatgtacaaatacgtctgctacttgcagctcctttgtttacaattagactctgttatggatacaatttctataaaagaataaagagaaacataaaccctcagaagtaagaaaactgtgtctgatgtcactacgaactcacagctacagaaagtggtaacccctctattatttttcccaccactgactgagccttactgatttggggttccttgagtgttcagatattgaagactcccagctgtaggcataaggcagaagcagtgaagaagtagtatctggatattacttgatactacatttttgggaaataaagggaaaggaaagtgctttggactagacactgtctctcaatgttctaggttttctatttcgtgaaaaagagaaatgaattaaggtctattccagagagggcctgaggtatccctaattttgaaaagtcttagatcatggagtaaaatagaagtgaagcaatggacagcaatgaaggactagatttaaaaatgttttcaagacacataggggatcagcttccaacagcacagaatagcctagaagcactagactggccctgtctctagtcatcagggataggggcacgccctctggacaaaggcactgggaagactacaagttaaaggagttaagttgccaatgcagccaagttctataaagcatccttgggaaaaaaggtcaaccgctacagcaacaactacaaaacaatctgtcttatttcaagccgtgtgtgagagctactagtcaggcactgctctttttagcttcatctgtgcccagggagattaactctatctgtagcagcacttgagaaatgctatctgccatgtaggatctgtgtgggatgcagatgaaaagaccagtagagccctaacacagtagacatataacatggtccttggggttgaattattttattgaatggttttgttgtacctctccctgaagctttgcgtaaaagaggtgtttttaaaaatttaataagaggaaatgtttttaccatcttttcatttctaaaattcttgttgaggtaatgttgaccctagagccttttgttaaacatcgttatttgttttgatatgtttccttgttgcaaagctttttttatgaagcaagagttcagattaaagatgaacagaggatttactgcaactagaataaggcgctgaacaatgttcactagcattcacatttccaagctctactagtgatgtgaactatatttagaaaaaagacacggggtctctttttttctctgacagtacatgttttctgtcattcatgcagctatttggtggttatatagtacactgctttgctcttcaaacagaaactttaaatgctactattaatcaggaatatcatttgcatacttttagtctcaactaaaataatttccccaaacttgagtcttcagaagataatgaatgccctgaatgtcaattctatttatttgatatttaaaaaccatgtcctttctcagagcctccaggcacatgcataataacataatccacagaagtacttcaagcagataaatgtaccacacaaccagaattagcagtacacaaatgaatgacttatgttctacctgggtagagcagtacaaaatatgtcattcacatggtggtcaaacaggagtatactcacgttcacttagggagttacaaaaatgaggacctaccatccattccattcatccatccatccatccatccatccatccatccatccatccatccatcccatccatccatccatccatccatccatccatccatccatccatccaaccatccatccgtccacccacttatttactcaacaaatactaacagtatgtttgctatattctaagcactgttctggatgtgtcagtgaacaaaacatatgaaggtgccagtccttgtggggtttaccttctaagtggggaagacagataataattaataagcataataaataaagtatatagtctgttagaaggtgataagtgctgtgaaaaaagagaaagtgcagtggggggatcggaagtactggagtgtgtgtatggtgtggcaggtgcagtattaaatagcgtggttaggggaagtttcattcagaggagaagatttggacaaagatttaaagacagtggattggctgggcacagtgactcatgtctgtaatcccagaactttgggaggccgaggagggcagattgcctgagctcaggagttcgagactagcctgaacaacatggtgaaactctatcgctactaaaatacaaaaacccagccaggcatggtggtatgtgcctgtaatcccagctactcaggaggttaggttgaggcgcgagaattgcttgaacccaggaggcagaggatgcagtgtgttgagattgtgccactgcactccagcctgggtgacaaagcaaaactctgtctcaaaaaataaaaaagtaaaaaataaagacggtggattggctgtgttgagggtgaagatttcaagtagagagaacaactagagcaaaggccctcaggaaggagggtccagcatatgttcaagaaataacaaggagaccaatggggttggagcagtgtgtgtgcacagagaagagagggaaccaggggccagataagtgagggcttataagacctggcaaggattgcctttcaatctgagggaaatggggagtcagggtatgcatttgagcagagttgtgacatgatctggcttacatttcagcagaatcactttgactgctgtgttgagtaaagctaataggtcttttcagaggctgtggaagtaattcagaaggaaggggctagtggcttggataaggtactaaagtaaaggcagcaagaagtagttagattctgggtatcttgacggtagaccagcataatttcctgaaacacaaaataaaatcatccttgttctctaacatggatcaggaatctgtcagtttggtggttgcagctgtgtgtcatgggtctcagcttgaagaggactgtattcgttcatcgtgtgtgggaacatatgggtgactggcagggacaggcttgcagcagtctgtgctcagtgaggattccaggggcctggaaagactctgctcagagattcaaggaataatagatgagtatcagagagaatgggtgattctgaatgattttaaaatctggcactctgactgtgccctggccagtctcccatggaccatcccttaagatgaagaggtttcaattaaatagctgtatcatgaaacatttttggacattgagaacaaaaggagtaggcagaattagcaccagcaactttgtcagcaagaagagatggtgccatattgcagatattggtgccctcaacattgggcaccagcagttggcaatgatggccactttggcaggcttcagtggcattggcagaacattcagttggcattggctaaggtgcccttgatgggaagacactgggtatcatagccagagacacagacatcagtacctttgacacattgggcacctgcagctctgaagcagcccttggcattcattagtggcagatttggcaccttcagtgagtatgaagaggactgagagcacttttggtaggtcctggtggcactgtctcaagctgtggtgacagaagacatcaccacaataggctagagcaagagaggcagaaaagggcagatgtctcatggtcagcggtagtctagttaacagtgcacatgtgacaggagacactttgaatgaatcattagaaggaatttcagtaaggcctagaatatgcagagaagtgttgctctatgattgttgctgttatcctattttgaagccctggttggagttcctgaaaaccccttttatatttatagttaagggataatctaagaactattccactaccattggagtgagaacagcagtcacaacaaaaaatagcttgatctttaggaaaatgtttccagcctcatagtctgttgtatgtgcgtgtgtgtgcatgtgtgtgtgtgtgtgtgtatgtgtgtgtatgtgtgtttgtcagtctagaatttctaattatctcagacaatggagtgactaagaatcttcagctctatttatgggaatccccagtagagtcactcttacaatagttttagtagttattatttatttaattcaataagaatttttaggcactatagtgcatcatatgtataacatcattctagatattgtatatctaggacaatatatatataacatcatcctagatattatataaatgcaaaagggaataaagttcctaccttccaggaatatgtaatttccttgggtatacatttgaaatacatgcaaataaagttctgtgtcacttaacaacagggatacatcagaatgtgtccttaggtgattttgtcattgtgcgaacatcagacagtgtacttacgcaaacctagatggtatcacctgctaaccatctaagctattgctcctagtctataaacttgtccagcatgttactgtactgaaaactgtaggcaacttaacataaattactaggtgatggaaatttttcagctctattataatcttatgggacctcttatatatgtggttcatcactgacccaaatgttgttatatggcacatgactgtatacaaagataagtgccagtttttataagttctagaaaaaaatgctagagtggattggaaacatttgggtgaatttcttttatagtttctcttggggttaatatatggtgaagtaagtgattgtatgtgtgcttgtgtgtacatgtttgtcagagagagggatgcaggtgggaggggtggggggcagagagagagagagagagagacagagagagagaaagggagggtgaatatggacatccatttctctttattgtccctagtcctagtcctagtcctagcaggcacaggcagcatcctctgtctgaagtgactccttcaatgtcctagttggctaaaaacacctgttcattctttgagattcagttcaagcaccatccacctgcccaaaaagctttccctgatccccatgcatttagctcttctctcctcttgtagcattttccacatagtattctagtttttgacatatctatctctgtctaaaatgcaggcagaactccttgaggcagggaccaagtcttctccatgtttccattcccatctctggacttagcatagagctgaaatgaatagacagtctgattgaatggatggacaatgagcaatttgctaatgaatgtctgtgcatggccgtgtgggtgtttgcagacgttatgcctctggagttgctctagcttcctttcatctacctctgagcctgctgggtctcgggacacaaggtaattgttactttatgtctacatcacgtggcactcagaaaagtgatctggctgaagtgcatgataatgtaattgagtcccagaggtgacaggcagggaaattgatctctctatatttactgaaataatctcttgtacatctgtggggaaaatttcacattcaaaactttcttatgatacatttacctcttagtatttagaaaattgtaaatacaatcctttgccaccaagcagtagcttccaagtaaagaaggggttgagggttaaaactaatataatgcattgaagaaaaagcttttaacctgtcaggactctgtgattcataaattataaccttagaaatcatttaaagtgtatccatttagcacttataccttcatgaattcatggaacaacaagtaaagctaaaatgtatttcctcttgaagacatgaaagaggaatcttgcagtttcttgggtactcgtttcctttgataagggcagtagttatctattaactgaatgtctatttactaaaatacaaagcaatagacttgtgtgaaatagtaaaaatggccagtcattttttccccaagatgagtaaattgatgggtgattccacagagtacagagacggggcactccagtaataggaagtagaggaaagcagttaagggcatagactctggagccagcctggccagtttcaatcctgactctgacacttactagtggtgtgacctcaggcaagttacttaacttctttgagctttaatttcttcacctgcaaaatagggatttaattttgagatttaaatgtgttaatttagagttaatctgaagtacttagaatagtgcctggcacgtaggcaattttctatttaagtgattgctattaacataggggtttggcccagaatgtctttctggcatgctgaggaacatcttggggaacgtgtattctttagatagagttcactatggatccacagaagaccaaccatcaggctagaacccaaagccaaaggataggtggaaggactactggtttgaagtagaaaatctcattgattaccgcccctcctcatcccccacaaaaataaccacaaagaaataccacgtaatgaaacagtgcttagcttagggaaggaagaatagtaactatgtcacttgtttagcctgcttcattaagctcactataggtatttgtttgggtttgaaatatttgactcattatagcttgaaggacaaagtgatgaatgaaatttatagctggattgatggcactagctgtatttcagctgtaataaccagaggatggttattacgaatgagaaaaaatagcatctctatctgcctgttagctaaacatatgctttggatcactttttgcttggagtgtcatgagttatcacaaacttccacaacaaagaagttttcttttttaactttgatctatgtattatttgtttttttagagacagggtctcattctgctgtccagactggagtgcagtggtgggatcatagctctctgctctctaactgctgagcttaagcaaagctcctgagtagctaggagtataggtgtgtaccaccatgcctggctaattttttaatttttttggagagacagggtctcactatgttgcccagccttgtcttgaagtccttccctcacgcgatcctcctgccttggcctcccaaagtgctaggattacaggcataagccaacacgcccagccacaacaggtaagttttaaaggtacataggaatggctttttgattcatctgtctccttctccaggaacctactcctgattccctgaacagaagagaccttcccttttacttaacgtacaaaacttgttatttttactcctattatagcttgtttcatgttctgacttgtactatattaagatcatttgcatattggtctgacttcctttgctagactaaaatcttcttgaaggcagatactgtgtaatttcatcttatttttctccttgcactgtgtcttgggacataagtaaatgctcaattcatttgcagacataacttgaacagaaatatctcacttgaatgccattgatggaaaataagaaatatagccaaattctattcaacaattaagttagcacttatttcaattgtatggtaaaggcaggtgacaatgccttattcaaaatggcgaatatgctgttttacagttttcgtgtaaatgcacacagttctgcttttctgtgaaatcacaatgcctttagcaactaaatggaactacactgtcaagatctgactgctcagcttctcagttcacttccattccattctatgctatgtatatttatattgagtccttgcttctaagagatgcagacaggaagatctctctgtattaggcttattcatttaatctctctcttttttttttttttgttttttgagatggagtctcactctgttgcccaggctggagtgcagtggcgggatcttggctcactgcaagctccacctcccgggttcaagtgattctcccgcctcaggcacccaagtagctgaaactaaggtgcgcgccaccatgccaggctacttttgctatttttagtagagacggggtttcaacatattggccagggtggtcttgaactcctgacctcgtgatctgcctgcctcggcctcccaaagtgctgggattacaggtatgagccaccgtgctctgcccatttaatctcttaaatagggaggcatgagttatgactttaaacaccttctcttctagcttctgatggactaaacaataatctttaaatacatttcaaaattatcagtttagtagatgacaatcaaattggaaagttttgccagtttcttatctagaaaatgaataactgcactgtgagaaacccactagctcagagtagaatgttcactatgcaatgcagtcatgggcatttttagtcacggactctcttaggtcagtaattgagttcttttctgttacttcttggctccaggcaaaagcaacatcaaaaatgtattgatttttgttaatttagggagaatttattgaacaaatgcaagtggtcataactaatattgagttcctctaaatgtcagaaacttcatatgcatttttgtatttatatctcacaatgacctaatgtgataagttccactattatctattgttttatagataaggacactgggattagagaatttaagtaacttggccaaggtgacacaagcagtaggtggctaaactgggattaaattagatttaactaaaagctcaagagagttattttttgagcccctgcaagattgcaagttccttaaagatgacttaagtggattatttagcttactcatctcattatccccttagtatccttagggtgctttgaagtacagcgtttagacaatacagtggggtggttaagaacctctgttaagccgcctcagtatgaattctagtttatccacctaaaacagcattcacagattcccatcattttctgtccatttcttgcttaatagttctccatagcatttatcattacctgaaattatatagttttacttctttttttctgggtccctcactagaatttaagctgcacgaggacagtgaccttgtaagtcttgcttcctaacaccaaattctcaatagctagtacagtgcctggcatgcagtaagtggtttaaaaatatctattgaatgaataaataaaaggagatacattttgcttaccgtttatgcctggagtcgtaattttcaatacaattaatgggccaaatgaaccctaccttttttcttggttcagcttcaaaccttctttttaaaagtgtatttaatagacactaatatagcacatatgctttggaaaactccattttatgtgctttacaaatattgacccatttaattctacagagaaggtgaaatcattacatccattctaaaggtgaggaaccaggcacagaaagatttagaaacttgcccatggtcagacaattaggcaaagaatggagccaagattcaaactcggatagtctgaccatgttcccaaccattccattatgctgcttcctagattaatcccataaaaatgtcatttccctggagtttaatgctctaaagatgtgtctttgctctcttagagaatgaccttccatcttgcctatttttccttcctctctacccagattaagaaggaaaataaattaagattattttacttattgaaacagcacagtatgctatcagtgaagcttctctcaggctaccttcaaggataaataagtgaatgaccccggtggctgctggacagctcacatggcctatatctgcttttcttctttttcatatttgtctttttcttgtatttctagagctcttggattcctgctgcaacccttccttctagccttgagaagggagttcagtggtccatggaggctgcaaaaactgccttttaagcctgaaatgtaaaaggaaggccgattttataaatgattcctgttcttgcttttagtcaattggttctttcatttcctgtcccttttcagtttctttcacaaacacacaagcaactcacagccttgggtctctgatatagcaccatattcactcaggaggcaattgtcatgagcacagatatctgggatttagttccagttcagttactaaggagcaatcttccttggggcaagtcatttaataggactgggacttagtttcctcacctgtgaaatgactccagtgagaggaagagctggagatttaaaggtcccttccagctctaaactgtgattattctttgacgaattatgtaaggaagggaaagtgctcagatatctaaagccctatttctctcactacagattgcaggataactccaagggagccactgttctttattaaatgggggtgaacttctcagaattgaaggatgacggctgctggggatagcaatagatcagaacctattttcctgcctaattccttccctatttctctgtaaatatcagaaggagattaggagtaaaagtgatatttcagctctgtggtctacataataaacgattccaagataaattcttaaaaaaaaaaaaaacactaaaaagttctgcctctttagcttgggaagaatgtagtagccatcttgctttgtgaaactgcacaaaaaacttggagcagagcatgggtaagtatgtttgaattgcgtgctctcacgcccagcagttgtttaaaaatctatccagcccatacagttattgcgattttgcattttgtacatatggggctttgtcatttcaaagggtgcaaagagcttcatgaacaatggccattccttctctcgatgtgaccccgtagaacagactagttattggtcatcacttgtaaacaggaagcatgaatctcaccctaggaaatgcaggccgccagtgctgtcatgcttacatgaaggacatgccttatccctttgtaaaacatttaaaaataaaggcactcagtttggaaatatctttgagcatcctaacctgacccattcagaactgacctctaatcagcatttttgtttggctcagtccagtctaataaatattaactgggcattactatgttcatgatctgtgtgctccatacctaggaaaggaagatgaacatggccaagatcctaatcttgagtaagagacaaattagtcaacaggtggtttttatgaggtgtaatgggaacacagaagggttaaatcatctatcccagagagaagatgttgtaaagatttctccaaggcttaagtattaaggaatgaataggagttacccatgggaagaaggatgagagttaaggtacagaaggagatgatgtttctggcacagaatgactagattctcaggaattctatcacatattcctaggaagagagataatacttcttggcctaatttgcagtttaatgagggctatgaacctgaatcctggtgaatcaaatgtgatttaaagtaagtgatgcatttcctgtcctggcaatagaacatcccaagtgatcttctatgttcctctctaccctgctgtcatggcagcccacaaagaactccaggatggaagggtccatgatggaagaagccagggtccctgaattactggttggaggagagctgcctgacccacactggacttagcatgtgtgagaaataaatttaacagtgttaaaccactgagaatttggagctgtttgttacagtggctaggttcattaccctgatcatactgtgtgccaggctaaggaataataaaagggatctgaatgacttgctgtcacttcaacatttatatagcccaaataacttaggtttttgaccttaacattgattactctttcttcctttctcatccaatggcaccaatgatttctttcttaaaaaggtgatcttttacagtctttcagcaagtcaactgctcctcctgagtatattatcagcatcttgtgtcttttaatgacatttgtctattgtatataattatataacattatatctattattatatctattattgtataacatatataatatacaacaaaaaatgtattatcgtatatataatatatgttttatattatatatactatacatttgtattataaaatatatatcatattgtatataataggttataataggaatataatatgttaatgttatacaatatagcatgtatatataatgaaatatcatttcaaaggtatctctatataaaaatcaatttttctcattagaatacacattttatgagggcaagggcttcatctatattactcattactgtaaccctagtgctaagggaaatgactagtatatagtaagcactcacagttattttcagaatgaatgaataaagataaatataatagaatagaggctgggttttttaaaagaaatggacttcagctgtgttcagatgtaggcgttctgaaggcagaaagagctccaaacccagacgagggttgacagttgctcatatgaaggtgatagcagaagctatgcaggcaaatgaaggcgcctcaggagggtaagggaaggaagaagatgagagaattaaggctgaattttagggaatatcaatgtataaaatagactaagtataagcagctaatgaaacaatattagaaaaagtaaggaaagtaaagagagtattgcggcacagaaacagaactctgtaagaatcacagttttggggtcagatctgtgagtacagcatattcaataaacacctgtctattgattgaaataagtgctgaacactgaatagcatatagtcccatgaagatggtcaaaggggctgactccttttctaaaagacatatagccaatgtcatccctgttaattatacacatttctctgggatgacatcaggaggcttgggttaccctggggcctttcactagtctgataaagtaggctatatttctgatctgagttcttccctgtttagaagattctcagaagtatggaaaagttcttaatctagctggatatttattgataagttacgggtcagtaaactatgcctacagtctaagcctggtctattgcctgtttttttaaataaagttatttggaacacagccacactcattcatttctgaatcatctatggctattttcactctgcaacagggttgagtaaccacaatataggacatatggccagcagagtataaaatatttatgatatggcttttcacagaaaaagtttgccaacccctgagcactgagcatatctgttttgcacccccggcaaaaaaacaaaaaacaaaaatacaaaaagcaaaacaaaaaaaaccccacaagacattttcagaactgagtggagcttgtaagaaccctgggaataccacagcctgtcttactaaggactggacctataggaaatagaatattctgtgccttcggtgagactgggtcccgtcatgtatttactttaggttaggacctccatgctaacagtgcacgtatgtgggtgtgagattctctttgaccgtgtatctttaactgatgtccactgggtggtaggccaacactgagtggcagtgagtttaagacatgcaataaaaagaataaaaagaaatgcaagtgaaaagaatgagggtagatggagagtgagtgatgggatgggagaatgaaaataagtcgccctgtcaaaaggtaccatgagagcatctatgcctgtgggctatattttgtcattgcccttctgaaaaataccagaagaaataagaacaagtttctatcatttttctaagtgacagggaaataagactgaaccttcctttctagacttttaaagaaataacattggttgtacacttttccgctaaagcgtacacacatctgcgtcaaccatcaagcctagaatcaataaacatctgaatgttaaggacttagagagcactagcgtctttaagagaatgactctgttctcttgaagatgctagttctttcaaggtccttaaaattatcttcatagaatgtctctgttctcttaaagactctagttctttcaaggtccttaaaattcagatgtaacttctttgaaagaatgtcacattcctaatactcctttcaaaggctgaaataacctgtgatctcatcatattaagacatttctagagtgattctcttcatctatgacataggggtagcagagtgacacctataaccaaatctggcccccaatgctttgttttgttaacaaagtgtttatgaaagaaacccacagtttttttggggggtgaggaggggcaggacttctgctctccagtgtgccacagtttccaccactccatattgtcttttctttaaaagtgtttgagttttcaatccctacaatctctgcccacaccattttgagggggccaactgttgctttgatctattttcttcgttcaggcctaaaattaaatgaccacttgtaactttctagctatgttagtttattagaacccgttttatttgctaacattcttcaagttttgtccaatagagtttagtagactcactgacctaatatatatggtaaaatactcttttcagtaatgaggcaacaatgaagaataaatacattttaagaaactgtgctgttttatgggattactgatttgtgtatatcacttagatcagtgatgttcaggttatgaagtgattatgtacaatttgcaaatatctagtgtccctaacttctgtattatcttatatcatgctacattatacctaactctacagaccagagacatgtgcctcttttttgagtggcagtagcaaaggtggctcttaaatcatctgactgtgaacaatacagtcccaggaagatggcccaaggaaataaagggtgtttttttccttgtagtttttgacggattattccattttaactacaaatgtggacaatggaaactaggctgtaaagtagatcattataaaatgtacctggccaacttctaagatgtaccccaccctgcccgccctaccccatggtccccaccgtctggtattcacgcccttgtgtaaacacctctattatgtatgaactgaatctggtgacttgattgtaatgaatagaaaatggcaaaaagatgggatgtcacttgtgtgattaggtagcaaaagactgtgacttccatcttgctagcactttcttgtcttctcacttgcttgttctgttgaagctagctgcatgttgtgagatgctctatgtggtgacaaggaactaagggaggcctcagccaacagtgtgtgaggcactgaggcctcagtccgaaaatccctaagagcctgaatcctgcctacaaccatgtgagtgagttaggaagtagatcctcttgacttgagtcttgagacagctgtagctgtctgaaagatccagagacagaggacccaatcaacattgtacctggattcctgacccacagaaattgggagataataaatgttgttatatgccactaaaatttggggtaatttgttctttaacaatacagaatataaatcatctattggaataacagcaaaaatttttttagccaaagcctcaaactgaggatagagaagggggtaatttaatccattcattcagaggttctcagtgccattcagtgaaaaaaataaatatatgtagctccaataaatattggttaaactgagcagaactcagaagtaaagggccactaaaattcaggtgttcattatgtagtaaagtaacagtagcaatgaacaaaagtgaataccagacgtcgcactaagatcaagagtcctgtgataacaatatttactagtcatcaaatatttttgggtttgagttttgaggaactccaggatttaaccgaggagaatgagtaggcagagagacaacagcagagatgcagagagtaactacgtattgtggaagccgaaagaagacaatgttaatagtgaaaatttgccccatggggttaacaagaatccttgagcttgccttgcaagaagacagacgaagaaacagcttgttataattctctctgcttgcaacaaaactggctgactggctgaaactggctggaaccaataaggctgactggagtcagaatggcacagaatagactcgctctcctggggggtgacgttttgatgtcacagcctgaatttccacgtcatgtttcagaccagttccccatgaatttgcacaggcaacccacggaaaagcacgaagggacaactgcgcatgctcaacggactttccaaacttcccattcctttctgccaatcactaaccaaccgggaagccccgcccccagaatctctcccttaaatataccgctttaaggctggtacagggcgacggatttgaactggattcctgcctccttgcttggccgccttgcaataaacctttctctctacaaaatccagcgcttcagtgtttggccgcaattgtgtgcaggcaaatgaacccagtttggttgataacaataattgtcaatagtatcagagtctgctgaagtcaaagtagggtggagataacaaagggcttatggaatttctgatcttctgcttactggtgaccttagcactggttgtaggaggtcgcagcagagaaacaactcaagcccttgagggattagtggagcaaaggaaatggggagacgttgagtatagacaactactaagtaattccaaaaggtattataaaactggaaagcattagaagaagaaatattgaaaaacagcgtgagcatacaatataaaagttgcttatgtgctgaaatatactgtcaactcaggttgagggatatgaagagagcagatgcgatatgagccttgacacaaagtcctgcaaacctttaaaatgaaaatcctttgaatgcctgaccttcaggtgttatattatcaaaggacagaagcgtttatgcccttttaaaaaggaaaatgtattagaggattatccaaagacttggccacatacaattcttttctggaaaaaactaagttttatgttgaaaataagtaatcaggtaatatccctgtgtccaaagagacagaaaaagcacaataaacttaacatttctaggacagtagaaaaaaagccattttcttgtggaactttgggtttgtttcctttcataaaaagggaaaaaggtgaaatttgatcttcaagaagtccaggaaagcttttagagctgagaaaagacagagttggggttggtgagggaagtagactctgggtgaaaacggataattaagctttacaaaaggtcaagcattgcaaaagacagcgagaaagatgcattctatgtgttgaatgtatcaaatgtagttgagaagatgtaaatcttcgcattggtgaatatttcagtattaaaaaagacatattaaagaatagctattcttacaaaaggaataaacttttttctttgaagcttgacacaacatatacaaataaaagcatgaaaaatatgctttgaagtgtgctaacacatcaagattgtactgagcaaagcaccttttctctgtttaggaacaatctcactaattccacaacacaatatgttaattaaaggatcccaggtagcaatcatggaatatttcttctcatgacagatgaagaatacaaatattctgaagactgaaattgtataaacaaaatgaagagacattttgtccgttttctggcagtgcaaagttaaagtgaatgcagatgaatgtgctggcaataaaatgacactattaaccatctgaagatcgggctcattacctaagaaggcaaagcatcaatttgtggcattacaacattctatttgtgctgctcaatgtgcgtctggatgtttttatatactctctactaatttgtgtgcagagtgagctcttctgcatcagcctctctatagaagcttaattttgtattgtttctcttatattattttctctaatgagaatgatattctgtattagaaataaacacttcatttattcttcaaataattctacgttcagtttctcttgttttgcattatcaagtggtgtgtacaggattacagatatatcttaaaattgaggtgctctgattaaaaatatacatttgaatgacatgtgaggaaaatattcattcactcagtcactcactcattcattcttaaaagaatgtctatgtattgggttaagcatcatgggaaattcaaggatgttgcactgtctctgccctcaggatgtttatagcatagaagtggctgaatgttattagtaccttgagataggaacaaggacagggccataaaatctcagaggaaagggaaggtcagtgtattttctcataccacaagtattacttgggtacctactatgtgacaggtgctattctagaggctggatatatagaaaagagaataagacagtcaaggtccctgaccttatggaccttgcttcctgagggtgagatggaaaataatgaagaaaaaaagcaaataaataatataacttcagatcacactaagtggcatgaagaaaaataaagcagagcaatagcaagaacagtgatggtaagggaaggatgtgaattttagctcatgaaggcccctgtgaagatgtcacattcgaatagagatttgacaatgtataggagcaagtgtatgaagttctgaaggaagggctttctaggtagtgggacctttgtaggacaggataaagactttattctaagtgggaaggaaattcactggagaattgaagcagggtatagcatgacctgatttatattttagaaggatcattccagatactgtatagaaattcaattatagaggggtaagaaggtaacctggacagaggttaagcatctgtgaatagtccaggatagaggagaacaatgagaacttgattcatgtagtctaaccaaggatgacagactggaatgcactgtggtagtccatctagatagaggtggttggtgaggactaggttgataattacttagatggtaaggagcggttccattttgaaggaagttgcacaaaggaagtgatatgatatgataatatctgagttgaactttaaatgaatggcagcatgtgacaaagcaagtagtcattcatggatttgttgagtgcttatctatttttatgaaccaggcactgtgctaggtgctatagatacagcagtatggaagccattgctgaaagtgagaacaacaaaacttgctgagaaggtaatattttaagtaaacatacacaagcagagaggtgaacaatatgctcataggaattacttcctgaattggttctaaggatgttttattcttttccatttagtgtagaaaattatgtgattaaactcctttgtatatttggctcagtgaatttgcaaaaggagtaagtgtctatcagtagaaattcaattcactgtcagttgggaaatttcatcagacaatttccttagaaatagtggctaatatttacttttcccacttagggagggagaaagtatagcctctctagaaagaataggaggataggagagtacaaaacctaggacaatctcaaatatccaggtgtatctattacagttcatctgccacctgcctccaatctgccccacagtctttttgcaaacagatgacccaacttcaactttccctccttctaatcccacttgtacactgcctctagaattaactggcctaaagtagtccagtcatgtccattccccagtgcctacagaataaatttcaaattcctcagcctgacacacactgacccaacctactttttctgctttatctctgactacacacttctcaattgttttaatcaccttgaattttcttcctctttttaaaattattttttgaattgcatgaatatgttatgaaatacacataacataaaacttaccatcatcgccatttttaggtgtatatttcagtggcatgaagtacatttgcattgttgtacaaatcccattggattttaaatgtctatttccctcatacttccagcaatttgttgcctgaaccaaatttgtttttatatggttcctggggcctcctgaaatgccttttcccatccaagtactaaccagacccgaacttgcttagcttccgagatcagacgagatcgggcacgttcaggttggtatggccatagatctgaaatgcattttcctttccttatcaattaaaatcccacatatctgaaagattcatgctcagattttgcctcttcctttaggctactttgacaccttatctggaaacaggaggtcaactctgttgctaggtaacacactgcttacagtaaaaatgatgcctggttggtaaattgcatctggactaggagggcctatacatgaactataaatacatgatggggatgtgatactttggacttccctgagtaatgactcgtgtaattaggtcccttgtagggaccatggaggataagtctatggagttgttgcaggagatatcgtctcttatggggcaggaggcttttaagccagggccattcctgcacccacccaatatgaatctagtcttcttgaacctgagctgccacctggggggccagaactgatatttgtactgatattaggactctcactgaagagaaaatctgaagcttccctggtggccagcagtgttttctgtatcacatttttctaggtaaatctcaagctaagggttcatgcctgtaatcccagaagtctggaaggccgaggtgggtggatcacctgaagtcaggagttcaagaccagcctggccaacatggcaaaatcccatctctactaaaaatacatacacacacaaaaattagccaggcatggtggtgtgtacccataaccccagctactcaggaagatgaagcaggagaattgcttgaacccaggaggtggaagttgcagtgagcctagatcataccattgcactccagactgggtgacagagagagaccttgtctcaaaacaaaaaaacaataaaacctcaagccaagtgtggcccatagtagtctcataagtctgaatgtgcagttggacctaagaagatctgctcttgaggttgcatcaatatgtagaactactgtactaaatacaaatactccttgcatgcctggactcaaaatcactgggaaccgtacacaggactagggcaataaaagtattgctcacctttggaaggagctggattgcctgtagaattctttgtctgtgcccagaattaaggattccaatttccaacaaatcctgatcttccataacattgcttccctgaaacaaaacagaaatgttacaagttaaatcaagcatttatactgtggataaataacaaggatttatttaatacagagaaaaccagtgagtgacctgatttttatgaacaaagacatagagtcattcttccgtgagggtgagggcagagtcggtcaccttgttactgatgtgaagtctaggagaaagctcccctcccctcacaaatatctatcgtggcttatatccacatggggttatctgcactggagattcattcgtgtgacttaaaactttgtttctgcacattgtgcacatgtaccctaaaacttaaagtataataataataaaataaaaataaataaataaaaaaagatccaaaaaaaaaaactttgtttctgtaaaaatgtgaatgcttctagtaagagttgccatttaagattatcagtgacttacacattgatatgaatgaatcatttttccccccttgatgacagattttgtgcggaaggctgatagaaaaattgacatatattaggcaggttaaaagtgagagttaatacttaatttcaaaatattgagtcacaatagcaaacacatagaatcaacctaaatgcccatcagtgatagcctagataaagaaaatgtggtacatatacaccatggaatactgtgcagccatagaaaagaatgagatcatgtcatttgcagggacatggatggagctggaggtcattatccttagcaaactaatgcaggaacagaaaaccaaacaccacatgttctcgcttataagtaggagctaaatgatgagaacacacggacgtagaggggaataatacacgctggcgcctgttggagggtggaggatggaggagggagaggatcaggaaaaataactcatcagtactaggcttaacacctgggtgatgaaataatctgtacaacaaagccccatgacacaagtttacctacgtaacaaactgcatgtgtactcttgaacataaaataaaagttaaaaaaattattgaatgccagacaccagatcacgatatgaagattgaatgatgaatatgatgcagggccctacccacaactgcctttattccttccagtcccgtgatggaaagggactgttcaaaggcagttaggtaggatgctgagactgtgctatgatggtgacacttgcttaggagtccagagggaatccagggtattttttcagagaaaaggacatctaatcagatataggaaaaatgggtggttaaggcatagcacctaaaagaggaaggacaatggggaaattatgtgcaaagacctgtgagtaagaaggaatgtagtatacttggaagcatcatgttctgggataatatggagagaggagcaaacggtaaggctgaatgagtaagcagagggcagaccatacagatattgcatgccatgctgagggcttcagactttatcctgaccataatgggtagccatggacagcttttaagaaagagagttacatgctgagattccaaatttagaaacattattttgatttctggggctgggcctcagtttccctacctataaaatgataaagttgagcccacaatgtccaaggaccagttcagtcctaaaattctgatttcaatggttattttaaacctgtgattaatatttgaatgcagaagtttacatattgctcattttatccctagattttaatctttcacggtttgtaagacagagtttctctttaaattgaggcgtctatagaggttcaagaattcagatcactattttttttgacaaatcaaactctgtcctacttatgtgtaacacaaaaacgcaagaatagaaatgacagaatatccatttatttagtgatgagtaccattagacactcaaagcaaaggagaatgaatttgaaagggtgattctggggcatggagaccactgtggttgttttctagaggcgctgtgggcatagactaacgtagtagtcacaggagcaaaaagaagcaggtggatttgcaaactatcaggaagtttgacgtggagattgaacatgtggaatgatgcagaaatgtggaatacacaaaaattcaaggcttgggcagtgagtggaacttgatgccttttcctgccataataaaggaggaagaacagccctggtggggcgcaaagtgagactaacatctttccctggacagggacagaatagatgcatgtaaacaacttaataatatcagactatgctataaatggataactggctgtgcttagaaggattaaagccactggaatggcacaacagctagggatttaaaacgggcattcactggacaaaagcattccacctactcatagtgtcattcttatgcttaagcaacaccagccatctcggaggaagcagaatgatccaggtattcagcagcatgataatgaaaagcctaatgaaaaacaaataaagccagtcttggcaacatgccacaggaaatattgctctcaagaaattactcagtgcacacaacagagcatggctgagaatacaaatgacttcatttagagaaagcgttattatttccagaaatggactagtatggcatgagcgagatatgtgataccattctgacttttactctttgaggagttacctggcccttaagaaaaaatctttcgtcatctttgtgctagaacattaccaggttttccaggtcctaacttaccaacccacaacttcagcccatgtagaatagaggacctggtttttttgcagaaacagaaagcatacgaatatcccatagtgtgcatagctactatctctaggtaatcctgacaactggatttcagtgtttgaatactgaaatgttttggtaaattaaatcctaaagatcactgttcttcctctacacctccaatatgctattttctgtatctcagtaagagaggagtccttttgaagaattatagggaagttagatatttttaaagaaggtgttgagtacataagaacatctttttgagccaaatttcctagcatataggataattgccaaacatttttgaaaaatgaaccaaaattatgggaagcacaagaaaaatagtgaaaatgtgtcaaaggggaaatggcactaattgggaaatggaaaggaaaggatttactgtccccagtgaggcatgctgttagaaattttctattttatctttttctataatacatagggatgccaaaaatatcctagtacatcattcagccagccttttgtccaaacactaggggacttggagtctgcagaactgggtttggatcatggcggggcaaacttggctaagtcatacattctttgtaggcttcctggtcctcacccaccaaatgaagcagtttaatgaatatgtattcagtttcaaaatgctatgatttcagccatgtttgatttttggttggtatcattatatataaatatagattgtatattttgaaattatgtttcagtgtttcagaatttgtaacctaaaattagctttaagaagtgattaaagagaaattcaagaatatatatttttttttgacaaatcaatcttggtatgatggacttataaaatttcttattaaaggaaattataaggtaacttatttttgtagtagtacggattcttatagcttttcagggaaaaacaaaatgtttcaaaccttataactatctaaccatttctttggcacctgggtgacagttgtgccatcaaagacaataaacattcccattcttcctagggagctggaattaattctcactttatcacttgcctttactaaatgctagcaaatctcagtttaacttctgttttttttttttttttttttttttgagatggagtttcactgttgttgcccaggctggagtgcaatggcacgatcctggctcactgcaacctctgtctcctgtgttccagtgattctcatgcctcagcctcccaagtagctgggattacaggtgcccgtcaccatgcctggctaacagggtttcatcatgttggccagggtggtctcgaactcctgacctcaggtgatccatctgcctcggcctcccaaagtgctgggattacaggcgtgagcaaccgctcatttttctcaataaaaactgaacacaactctagctttcttcctcctccatcatttttttttttcacataacttttaggtcaatgatttgggggcagagctccgtcatgtccatcttctgtttagtcatctactacactgcactctcaatctcctttcctacccagtacactccagtcccatgttttcatctcccattttcctcctcaacccaccagaataagctgttcccccccatcaactccatagaacttctctgtcaaatgttaagaatgacccctcaattgccaaatatagttgattcttttaaatcttgatttcaagaatttacttgccatatgtaggtgatggccaccatattggacaacaaagatacagaacatcgccatcattgtagcaagttccattagacagtgctactctacagttagagacattgaaactttagtcaaatcacaaaaatggggcagtagcagggaatcaaatcagggactcaaaaatactcatgagtttttctcaggatgtagttattcatgtgcctcttagtcaaagttcatgaacattaagtttaggatctttagcaaattctcttttaattcttcagtcaccaaaagaaattagaaggttgttctactttcagcaacatttctttatggtggggctataaatctatgctatgaaaatgacaagtccaatcactaaattatttttgactttcttagcatccaccaatcacactgcataaggtgtttaaataacaataatcaataaataaagttgtttagttaatgactttctagaatgatcaaagacccaaatgcagtatttttagaatagctgttctttgcctgtcaagaaatgtctaatgcagggtgtctttattgatctcttaaatcatggaatggaaaaagtcacctaatgttttatgcactaatagctgaaagtggaagtttctttgaccacggggagaatatcttaggtactgaacttcttcagctgtgataaactgttaggatgcccaaatagaatgaaaagcagtgttttgtatttaattattcattagaagtaaaacagctatttaccaaaaacatctcaaaaatatctgtactgatggctctgtctctccaaactctgcatttaaaatttcttgtagttttttaaacttaatacgatatcttattcatttagcaagctttccttcatattatatattgtagaaaatgttaggaaaatatatttaaggaccacagggaactggcttattcttaatataaacttgagttggataatgttatttattctcttccttcatccagtccaagactaaaaaaatcaagatgatactgttgattggggaaacttgtttttgctctataattagctaaattagattcttctccacaatttatgtgaccttaaatatttaaaatagaatcactgtataatagaatgacagcaagatcttacaaacttacacatagaaaaacatgtactttagtttgcttttaatatttagccttttataacataaatagcatggtagcatgaaactgtacataattttcttggaataacaatgctacctctctgcttctataaaagctttgagtcaatttgatatcaatttacaagtaaacccaatgcatgtcttctctgcatgattatgataatggttattgtgctaaataccagatttattattcctctgtcagtgttggaacaaagctttatttagcttatcatatagaaacacgggtgactataactgatcagataatggatgatgtgcttcttccaactttaacttcctctctcacattaatgaaatggcagtggaagaaaattctatagtacactaaaaaatccctctaccctaatcctccatttaaacatattctgtctaccgcaataaaatttcttgcatacaacttaagtaaattttcatgtttttagcttatgaagaaagctttctggattcttcagactatgtggactattgattcaaaaaatattacatcactgaccaataagacatcatcttatatgtgcaagctgtgtattttaataaattatatcttaaggttaagatatagtttagcattatatatttaacagctaccatgattacaatgaattttctgtcaccgattttttcctctttatttttgaaacccaattcccctttgaaacatctgttgtcaagctacagagaaagagaaggaatttaagtaaccaggtatttatttgttaaagtatcgagcaggatttggtgatatcataaattataaatgtaattcacttgagatgtgttcatgtaggttttagaattatgtgtatttgtaaaagagtgcaaaataatttatacagtaatttgtactgcctttggtcaaaaattttatagctatgagagaaggagcctattcttcatttttaaggatgctaacccagagctccttcaagtaagaagaaaagttgatgtgaacaaaacttttttgtatgctcttacttctctccagatgcatatatctgtataaatataaagctgatgaatacctactgtcttccttcaactttcacactgatagcagttggtgttcattagtgtaaagtaaatagcacacttactgtgtcaggcactgttctaaataccttccatatattactttatttaattctcacaataactcctatgaggtaggtagcttgttcccatagctgataggagactttctcaagacttaccctatactacctctagcaggaatcatgcaggagataaaaggttgagttaaaaaaacatggttagatccacaccatttatatttttacttcagagtcatctgaaattcacatttgaaagcgagtgttccaatgcatttatgtttgatttcacagtaccgaagcaacaatgaaccctctctatggaagagaacttggagagctgtctggcctaatcttccctgctttgctccagtcctttctgttcactgaatcctggaatcaggcttggcagggacctggggggtttctagtttctagtctaaacgttccctaactacccacaaagcttcaacttctcttttgaagtgtggtgtctcactgggttgacaccatccccagagaggtagggaggatattaaatgctttaaatggtctttcccagcagctgagtctgagcagggggtgcggctggggttggggtggcacctctgtcctactcttttagctcccactgtggtacagaccaagtgttgcaggagagctatctgaagaagaacgtgccagaagcggagatgaaaggaaaacagttagcagctgtcctgtgtccttttgtaatcacaagctgtgaagctgaaaaaaaaaaaaaaaaaaaacttccttgggtaggctgtacataatcttggcagatatctgagtgttgttcttctgtctaatatgctgaacgtttcccagtgcctcacaagagaaaagtgagacagggttaggtgagtttggacaccttgctccgaacaggcagggaacatggcgcccttgtacgttcatcaagctcttgcaaatgccctgtcactgtagatgctgatgcagagctccaaaaggaagggctcctctgcaggagaagcaaaaagaatttgctcctgggtattcccaacacagccacatataatgacgcagaaagaagtacctaaaaagattaccagccattacattcactgtgtagcaggtacttcacccaccttatttataaaccttacagcactcttgtaacataggtggtattattttcatcttatagaggaggaaactgagtctcagagatgtgacactatggagtcaagttcacaagataagtataggatggatctgggatctgtgttttatttggtcagactctgatgctgatgcttccttcactacataaaaagaaccaaatgtttagtaggggacattttctggatggagattccggtccatagatatgtaacgttaccaagaagttactcccatgaccctattttcacacacacaagcttacatctatatttacagaccatagggagtgactgccagagtttctccaacacattgaatttcacataaattatttatcttctgaaaggtcaactggttagttctccttctaaactaccttagtgtattccagaaccaaacatgttaatcaaagtgacccaaggtgtttgtggctaaagcactaactaacttgccatgtttcctgctgtgaggcaggaagtatcagcatggcattaggttgttgtgagagattcagctcttctgcagtgccttgtcaaacgacctgactggtcaactgggaaaatgaagttctcagggccaacatcgtatttgggtgtttttcttttaggtctgtatcaaagccagatttaagaaggagggtgtctacaaatgaacgaaagcagaggatgtctggggacaagctaaggacatttgtgtcccacactgcatgtattctgaatccagagaaaagagagtgagttgcagtctcctgagaaggctatccaggctaaggagcctgtgatggtgaaggtggataatttagccctctgagaagtgtagacctgtcaaaaaggagattcgttaattcttcaaagatatggttgtcttcaaagaacagacatccccagatttaaggatgatggggtctcttgacactgagaactacattcagaaatagccaaacaagaggaaaggagcaaagaggaagagaaagggagggaggaaatgagaggaagtgtttattcttaagggtgaaggtagtggtgaagggagtagaatttcctgataaaatacagaaattcaaatttaagtggcatcatgtatttttattcacttaatctggctgccttagacaggaggtcactgaaatctggaaatgagctggcagagtccagtccagagctaccactgaggcaggcattgtcattcattcatgtagtcagcatttgtttgttcaataaatattttttgagcatttattatgtgccaggcactgggctgtggttgtgagatacaatgagatcaggacagacaaggtccctctacctttagaatttacagtctagtggagaaaaagggaaacagtggaataaaaaaatagataaataattatttagcaaagttttactatataccaagtatttactgtattagtagggactattaagcactttgtcttgtttgttgttcatgataaattctgatgttagtatatacaattattatccttatttacagataatagactaagaattgaaggcacagaaaagctgataattagtctaaggtcacacaggtagtaaaactgacataaagggaatcaatggagttctaaaataaaaaataaacaaataaataacaacggagatctatgttagaaagactggtgaggaaagtctctctgagaaagtgacatgtaattaagacctgaggggattagaaggagcagcctaactgtgagaagagctgttacaaggacattccaggcagaaataacagcaggtgcaaaggcactgaggtgaggaaaaaggtgaggcatgttttaggaacaaacagaagcctactaagaataaaatttagtgactgagggggacgaagacctgggaaagaaacgcaggaaataagacaatacagagacttgcagactctgataaggactttgattgtattccaagtgcaatgggaaacattgaaggaaatatactaatttgcatcttcaaatatactctggattcggtgtggagaatggatggagaaattgggaggtatggaagttgagctcgacaatcaaaattgaaataacagcctagaaacataaataatctaaaggaaatgtgatgaaatatgaccttttgggagactatgggaatgggtctcactggggggggggtcaagtctccaagccaaatgcatcttttatttgaatcaaagagaaaagccatatgacaaggatgaaatcagaatagtctttgataaaggttctatgtggatacaactatgaataaagatttagcagtacctacgaaaatgaaaatgttcagactccatggacccagcaattctgtttcttggtcgtggcagacattgctgggaggctgagtcctttccctctcactacctcccactgcagaggctggataagctaaagttctcagcttccctttaaagcaatggttgaacatgtgacagaagttgtcattggggaacttctggaaaagcttttgctttcctaatgaaaagggaaaaattcacctgctacccttctgtgcccataagaaaggactctcctcaggatgagtggctaaacagttcagagaaggtgacagcgatgggcccacagtccttggacctccaatgatagatatctccattggatacctggaggcaggcaaggataggccatggaagggttagttctgcataaaaaacgttatttaaagctctctccatcttttgcatctaagttgctctgactagtgtttatctgtcagtgaaaataatgatggggatgtgtactgtggcatgtaattaatagaggttataatggaggcaacaggatatttactatttattttaggcagacaggggtatgataacataaagaatagcagagaagggatactaggaagaatgaaagttatcagatccaagttggggtgtgtgtgtttgtgtgtcaattatagcattgcctcttctcattttgacttaacgttgtgaatttctcataaaaagatgacttgaaggaatttctttactctggattttggtttctattaaaaactaaaacggatgcaaaattgccaaagtgctcatgggactaacaggttctaaatctgggagtgggtttcagcttataattgaagatgacaggtgtccagagattgtatgaagttatggttctaaaggaagtacagttttacataaacctggtattctacaggaaaaaatgttactcttgaaatccaaacacattataatcataacagggcagaaacaataagaacatttaggggtatgttaggttgaccttagtgtgtagctcttccaggaactcttgagaagtcagagtttttatttaggtcctttgtaatctggaatgcctttggtgggcagtgaatggcgattattgaaagagttgactgatagaatattcctgacttttccccacatttatttttagttttggttttggtcttgaagacatttttcttaagatgtcttcaggaaaaaaaaaaatttttccacattgaaaactttgttttggctttttcgagtttaaaattcggtgatgggaaaacttgctcacatcacaacaatgggattaagtgtgaggagatgatcgctgtgggcagacaggcaggaggctaaccccacgaagggctaaactaaaagctgagtaagagctccactaagaagagctctttgaactgttctgggactggctagggccactaattgtccttgggttgtatatgaagggaaaatttgtatcagggacacaaatatccttgtcctttgtatagcatctatatcatgaaggatattctcattttttaactccattttcttcactgaataatattactcaacctgaaagaaatacaggggaaagaaacggagggacatgcattctcacagtgaatgtaattaaatgtcctcctgtctagtttttcaagttaaaggttctgagttttgtttccagaatattcaactggtactaaaagcatcatgaagtccctcatatttaattaaatggtgcattattaaaagggggcacactctatctaggttaaagaggtgataaacagctatagaatttcatgtttctttctacttggtattatatgtcttgtttcctttactggacagcaaacttcttgggagaaaggatcatgcctgaagcatctttgcatctcccctaacatctgtttgctaagtgttgaataaaataaaagcttgaaagaatgaatctgtaagtaaaaacatgagttttttagatttattaaaaaacatttagtctaaagatcactaagtaagtttataggaaaagcactgaaattttgagctggaaattctaatatgcaggatgcctgatgtgtttttcccccctaattgaaagaaagataaagatggaattgctggtacaccataacaccaaaatgttcttaatttttttttcagttttgcaaattctcatgatttgattttcatccaggactgtcagttgagacatctgataatctaaaagcattcagagaattaggatcccatatggctcgaaaatatttcctatccggcaggaaaaagagaacataccatgaaaataatactggtatatccttcaatttatgtgtacaaggagcataaataaatttaaatcattattcaaagtataataattataatgatcataaggttgattataacaaccaaaataaaaagaatatacagttcttcataatcatgtgacattataaaaaatcagaagtatacttcaaatcaatgatagtaatagagttgtgtttgtctaacagaagcaacagtcattagaaatgagcacgggattaggagtcctggcttatcactaattaactgtataaatctgaaaaggtaatttaactcccttaggtcttaattttctcaactgagccatgaaagggctagaccagatgttcccttttaacacggcatctgttctggaggttctaacaaggagtacatctactcatacactcctattgcctgaagaataattaattcttcttgctttgggggaaatgtcattttcttcagataagtgttcagtattgagaggtgcacttacataatggtgagggagcaaggagacctgggcttagtcatctaatttcaccaacaaaattattactaacaataacaataacggctattcattgagagttaactgcaggccagacactgtgcttttatcctctgaacaattctataaaatagatatcgctattatcatccccattttacagatgagaaaatggaagcataaagattactaggaacttggctgagatcacacagtaagtggcagagctgctttggaaatgaagatgggtgttggaatcaaattcccctcaccccactggcttcccatagctttgacaagtgtcttctgcatggaattgcctcagagatctgatggatggagtctttctctgccagcccagtcgtctccatgaacctcctttcctacaatttctacccagggattgaggattattaataaaaagaaaaggaattgagtgctcctgggttcaccttacagctctgcactttaatagcagtgtgactcaggatcagcaatcctctttctttgtccgtacaatggggataacactaatgcttatcttttaaggatatggtgacataatgtttatgaagttgctttataaactctaaagtaaaattgctaaaaataaagcatgcctgctaggaactactttttttttttttttttttttttttttttttttttttttttagaacatagcactgtaaatcttctagtttcatgttgtttttgctggaaatagtctattctgaaagaggcagcatgtgtgatggcagaaaaattcagggttcccccccccacccccagctctgccatttacttagctttgtggccttgggaaagtcacttgatctggcatcccacagggtcccatactctacaggccctgcatttggggtttaatttctgtggttgctgttttgaagttcttcctaatttttttctttgagtttgtgtgttataagtgaagtctgaagggacaacggagcatgcgctgggcttggcaccttagatcatgggaggtcttgcttcctgctgcatctccaggatgggttctgccagagaccctcttcattggtctctctatctttagtcctgcccaacctccctttctctgttgagtcctaaaattgctgccatccttcactcctagcaggagtctgggtgccggcagagggagggcttgggtgggtcactcaaacccatggcaccttggggccgagcatggcatcgcccatccctgccctaacaggtagcagcattccaaatcaaatgggtgaccagccagaagctatcccaatccagatatcaagcatgtcctgatgaagagatttaaaaatcctttgcggggtgggggtcccctgtctgctatggatggaggtaatgtggcactggataaaagagatgcctggttagattttctgggaccctgctctatccaggacactgtggtagtcaggagagtgttgggggcctggcagtggggcacctgtgccctgcataggaggcacggtccagggtgcttgcatggggctgcactctcactacaagtgtcttgtgccttggaatgctcctttggctagctccatgcctggagcattctccctccttctaaccgtcctgggtttggcctgtatttgtcttttttgaccagatcaaggcatcctttggataaaaacacaaaatataaactggggaatttggtattccttcataggagttaaatgctttaatattttcatctaaaagtaacattgcacaatataaaaatgaatgacaaaattcatgctaataacataaaattttaatgtttctttacacagaacattaaatagtaaacaaaaaacaccatgacaagtctaaagagagaccacaaaaggaaggaaaaaggtttgtacgtatttttaatggcactctttcccctgccttttgaatagggggccccacattttcattttggactgagctccacagattatgtagctggctgcgctcccaggatgtaaggtttgcataatcacctggtccttgcttcacttcacaggtatatttgcagcagctctgcttgtagttggtaagctcagttaagcaacatagttggactgacttaagaatagcttaccatccaatgatctgtggctttatctttacctttccaagtgggtagaaaaggagtaatgggagccattcccttggaaactactgaggtcatttaaccctaacaaggatgatgcttcactagatgttaattagagatcatttccatttttagttttagttctagaggttgccttaaaaattatgagggcaacaggaaacactgaacttgcctagacttctggggcttctttattcattgacttattcattcacccattcaatcattccctccttcactcacactatcatttcacaacatttactgaagtgctatcatgctgcccacactttaagtatggagaattcaaaagtgattgaggcagtctctctcctaaagaagctcaaagtcactgggggaggggtaaggtggaggtgggatcagaaggcatataaagagattatttttattattgttttgagacagagtcttgctatgtcacccaggctggagtgcagtggcatgatcttggctcattgcaacctccaccctccaggttccagtgattctcctgcttcagcctcctgaatagctgggattacaggcacatgccatcacgcccagctaagttttgtatttttagtaaagattgggttttgccatgttggccacgctggtctcaaactcctgacctcaaatgatccacccgcctcagactcctaaagtgctgggattacaggcgtcagccactgtgcctggtcaaagagactatttttttgatgcagcacatacaatgattatggctgtacagagaaaagattcctgaagtacacagctttggatcaggaaagacattttgggaagcggaacatctctgctacctgctaaatgatgaggaaaagttaaccagaatacaggcaatgcttgaagcaagagagagaaggcactgcgtggatcggttgcagcatgaacaagggcaatgagaaaagaaacggtatagtgagagtgaaaaccagaaagcagtttacagttaaccaggtggaagaaacagggagggagagaccaggtagccagccttgtaagcgatgatgtgaagtgggcttcatcctgtggttctgggcagttggcaagttgttttatgcctggaagggagatggctggatttacaatgtagagagcaaactccagtggctatctgaagtgtggatttgaagggctaaaactggaggttggaagcccatttaaagagctcttgcagccataatacaagagacaatgaagatctggactaggacagcagcagcaggaatggtgatgtattaaagaaatactatagagccaaaactgactgaacttgattattgattaaatataggtattggtagaagacaagtgttaagaataactgtcagcgctcttgtttgggtaactgatggttaaggagtcaggtgagaaatagactttcagaggaggtagagggtttggaggtacagtgttttgttcttgtttttgagacagagtctcactctattacccaggctggagtgcaatggcatgatctcggctcactgcaacctccacctcccgggttcaagcaattattgtgcctcagcctactgaatagctgggattatggatgtgagccaccatgcccagctaatttttgtatttttagtaaagacagggtttcaccatgttgtccaggctggtcttgaactcctgatctcaggtgatccacccacctcagcctcccaaggtgctgggattacaggtatgagcccctgcgctcagccttgaggggctgtgttctgtttgggacatgcttaggggcctgtggaactggaaggaggggatgttagcagacagtgagaggaggctgaagtttggggagaggttcaggctaatgttgtagatttggggatgatcagggctgaggtggtagctgtatgaaatggataaatgcagcactgagaagaaaggggaaatgccatgagagaaagaaggaaaagatgaagttaatgaggaaaagagggagagtgtgtcgtgtcagatgccaagagggtaacgagtttcatgaataaggatatgaaccaactgttaaatatggcagagaagtcttaatggaagtggaaaaggccctttggtttggtaaaatacagcagctcatgaggaccccaggaggagttttccattatgggtacaaaagccagattagaggattgtgagacaaaaggggtggagacaatgaatgtagacgattgttttgagaaatctgaatgagtaagggaggagaaaatgtgcagcacagctggagaaggaacaggatcacaggaagttgctttattttcttcttcttcttcttcttctttttttcactcgtaagaataggaggtgactgggtgcactgggtcatgcccgtaatcccagctttttgggaggctaagataggcagattgcttgagcccatgagttcgagaacagcctaggcaacataggaaaaccccatctctacaaaaaataaaaaagttagctgggcatggtggcatgcacctgtagtcccggctactccgggggctgatgtgggaacatcatttgatcctgggaggcagaggttgcagtaaactgtgatcataccactgcactccaggttgggtgacagagtaagatcctgtctcaaaaaataaaaaactaaaaagaataggagactcttagctgggcatggtggttcacactgtagtggtggccacctgggaggctgagatgggagggaaaattttttgaggtcaggaggttgaagctgcagtgagctatgatcacatcactgcaccccaacctaggcgaccgatagatatgtgttttgaaaacataacgctcagagcaggttgaaaccctgtctcttaaaacaataattgaaaaaaaaaaggagacacttaagcaagtttgcaggcagcaggtaaagcactagtggagagggaagttggatccacaggagagggaaaggaaaactgctggaggtaggaggggtaggcctggggtgagataaagggcctggaagagggaagcaaggatgggtgaggtgtagaatccttactcctgaagcccttcactgctgatacttctgctatccttggcatgtgacaattcctcaagctgaggtcaatgccactgtgtcaattgcatagcaattctctttcttggggattcctataaaaactccctcataacaattccccaagtctctagtcttaccttgacgcccctcagtcttacacaattccttgctattttgactagtttgaggttacccatcatgaactccttcgacatctctcctatcttgatttatatactcttcttggtctcattttttcctgcaatattaaaaattctactgatctttcaaggtccaactcaattgatatcccttatctatgtctcactttcatcttacatatacatttttaaattacttgatgtcttttatgttatcttataagctaatttaaatacttcttaaaacaaggaagggattcaatcaacctatcaatcgtcatgataccctttcctatctcatcttcttttcatcttcttcaactttttgactcatttttatatcattcctctatgaaactattaaaccccttaagggcaagtaaatgttttttgcacctgctctagtatgacaatacattatacataatacctacctactacaattaataaattgtaagctcctggaggacaagaatttaggagttagctagctagatagagatgaatacacatgcagagatatatttacattctctcaagtataccaatttaatctaatacttactatatacttgctagcaattagagatatataaagataaataaaacaaaacacagtctctgtcttccaagggtgccaatccagtgtggcaatcagagaatgagagggcttgaatgacatgctgataaaattggactgtattctgctaggtttcttgcagaacttagggcagaggatattaatagatatgtgttttgaaaagataatgctcagagaaggatgaaggatgaatttgaaaagaatgagattgagggtaggcagatctatgagggggcttttgcaatagtgtagatgacagataataaagatcaagtgagggcaagttggttacagatgagatattgagtgtatatgcgtgtatgtgtatgttgggggagtgaggttgtggtgcacaagaataagtgtccagaagttatttgctaatcttactttttaaaagacattaaatggtaaatagtagtaataactatagcttattacatatcgtgtaacacattcctctagactggccttaggcaatattgagatctgttccatttcaccacttaggatcctctaggcccgattttggcactttattctatatgatcggctatttgttcttctcttattacttcaggtctcaagttttgatcatcctatgagcccatatatccttcagagcaagacaatgtgaataggcatcgttgcacttggtagagggttaggcaaatagtggatgccaaataaatccttgtggaattgaatggtattacctggagttccctgaaggttgtacatcctcttactccttggcctttggaacgtccttctctatacctggaattcttcctctctctctttacctcctctgactactgtctctttacctcactttgaccttcctagttctgtttatcacttcctctaagagttgttgcttgatgcccctgcactgggttagcagattttgctaagtggtccacagaatcacctacttatgtgtttctctgccagctctataaagacagaccagactaccttgcggtaatttgttcagtattttatccccaggttgagcacagcacctggcatacagtagacattcagtaaatatttgttaaatgaacatggttttgtggggttttatttgtaaatctgaacattttgaaatttgaatcttcaaatagctggacataaagtgctagatccatccagacgaaagaaataatgggagaccatctagaaaagtattttgttctttatgctattaaattcagtagaaattagttattatattttttgaggactgttatgcaattaacactctggacaacatgaagacagttcagatttcacctttctatcctgccccccaaggacatgcaaaatatctgcttgggtacccgttttttcatgtgtacacactagcatcttcagttgataagttcctgtggggcaggaacagtaaacttctcagaattagaaagcaaaagtgacagcaaaaacacgacaacatcagaaagccagattctatgtcagaaagtcttaggagttgtagctttagtgttctgcagacaacccaatgtcacaggaaatactaattcccttgctctggggcatttattaaaaacaaaattttttgggaggccgaggcgggcggatcacaaggtcaggagattgagaccatcctggctaatatggtgaaaccccatctctactaaaaaatacaaaaaattagccaggcgttgtggcgggtgcctgtagtcccagctactcggtaggctgaggcaggagaatagcgtgaactcgggaggcagggcttgcagtgagccgagatcatgccattgcactccagcctgggcaacaaagtgagactctgtctcaaaaaaaaaaaaaaaaaaaaactaaaactaaaacaaaattttacttcctactgcctggtaccatattatgcagtagagacagaggggttaaggaaatcaggcatagtccttgttctcatgtagtttgtagttaaggagtgagagaactggcagtgacctgattttgaagaggctgattcaggtcaagacccaattttgaagctggtctccaacaagaagagtggtttctaggaatatagctctgcacaagcaaatacatatcccttagacagtctgtgacatggagtgaaaaaccctccctgacagatcctttactagggatctctgcaagggctcagatctctacttcaatagaaatgctcattggtactatctgaggacgatttttccaagaggcacaaggagatcaattactactggcagcctaatttgcaagataaagaaatttcccattattctagtatcttcgcaaccacagtctacttcagcatcatcagccgacatcatggcatagtggaaaaaaatttggaatagctaaaaagtcacagattagaagttctcatagctgagatgctgctatgtgcttcttgttaaaatccagggttaggacaagggtcagaggattcttgtccttctacacttgagtggcctacagccatgtattcttctaaatcatgttttgaatttcgtcttgaaagataatgttttaagagtgctaagcttatatactcatacaacagaaataatatgtgtgataaagttgggcaagaagtgcttttaaagttgtcggtttctaaaggtgtctttttttaaatgggtacttaatagttatacctatttatgggatatatgtgatatcttgatacaagcatacaaagtgtaatgatcaaatcagtatccatcatctcaagcatttatcatttctttgtgtaaggaacactccaattctactcttttcatcattttggaatacacaagaaattgttaatcatagttgccttattgtgcttcaaaaaagttgtcttttaggttgtcttaaaatttggttacgaattgataacactagtcagaatcatgatttatattctgtagatcatttttttccatttagctttcagttataatacctcacagaataataaagcttgataggttaagtgtcttggtcctgactatcttgagaataatggttggagcaagaactatggtccagacgtctgctctagctgcaatgtttcccctccctactccattacaccacaatgatggatgaatgacggatgctgcagcagaagtaattacagtaaactcaagatataaaaacaattaatatagtgaaaatatataaattaataataaatataaaatacatgcatctttaatattaagatgtaatataatttataaattaatatagcaaatacagtaatatctaatggacagtgaccccatcaccccacttttacacgtgcctctaagagccatttcttatttttgaaggggagcagctacaccctcactctttgggttgcggtgccgtgtagaagtgatgagaatgggaaactgatacactcctgcacagagaagccaatctgaatgccagatgattaagtagaaacctccaccatgctgcctcagacttacaaatgaagtgcaaattaaaatgttagatagacatactcaacagcctgtaacatcacaaggactgtctttggggtatccatttctataaaaagaaaatctggcattcctttttggaacattaggccaaagtagaggataatgagaacagaaatgccttatgcagtcttaataatctttctactcagaggattcagtggaaactagtaactaaaaaagattagccttgcatcaagaccgagctatccagaaatcgcccggcctgggatgcagattcagtcacttaagtgagttgtaacacaggctcacttgtaggtttgccacaattttcttgcaattcagttccttcctctgtcaggctgcaataatgagatgaattcctgcaagaagtactcccagaaagacacagggaggtctgagtagataactaacacagatatctagagaacagaagtgctagacgaagagagaaataaacacacacaataattaaaacaaagatttttttaaaccatagcgacattacacttatctcaatctttaaaatccaggatatctatatctttgtgtatttctcactgaaactttccctgggcctcccaggaagaacataaagaataaagaataggttcattttcttacagattaagagatgtgaggctcaaatgaccttatcctggtaacatagctacattactgcaagagcagcatctttaatccctatgattcctactccagtcactctttaccagtgaaccatcaaagtaggtgatgatgctgaaagaggtacagaagattcagcttgtgaagataagccgaatgacagaaaatgcactttgtgcaaacctccatgcagtgatcacaatgcattttagccagtggttcagttctctctctgtccaactagactatgtaccttgaggatagaaaccatctgtccacctaatgtccccagtagtcagcacagtaactaacacatagtagtcaattaatatttgaagaacgtataaatgaatgaatgaaagcatgaatggatctggaaaagttgccatcaggaattggggccctgaagaaagaatggggttcataaataacattcagcaatcatagtcactgaattgggtactaatattagtgaaaataatagagacagtaaaaccaattataaatagataaagaaggtagtgcttgttctgttttgtttcataaaagattgacaattttatttatgaacacaggatttgagctaaaaagagaacagataagaaggtaggtgactaaagaaatggttgccgagaaaaagtatgaaacagagtttagaacagagaagaggatacagagataattgtaaaggtgtttgacagaaaaagggaaaaggagaaaagaaaaagctttcagtaggacactttatgggcataatagggttcttctttagggcatttcggaagttgagagagcaaagatgagaactcgagagacatggaatggacaaaagagaaagggaggtgagatacatggtactgatcactcacagggaatgaggaagggaagtaaatggcctcaaagaagtcatagctgtcatcgagcagcaaatgccttctgtcatgcaggtggaattaaagcttaaatgtgaactgatggtccatcttcagcttctttctcttctcgctctgatacctgccctcaaggttgctccctggctggtcagggaactcacactgagctgtagaatgttcccaggctctggacctttctgtactgttattcaaccatcagcacttgctagcttctgtcctattctctcaggatgcctgtttttattaaatgacaaaggaagttaattggttcatcaagtagagcaattcctattgtgggcttagctggctactagttaccttgcctattacatataacagcagtgaaataaacataaaggaatgaatgggtgggctttcattacgtgccaggccctgagctagatgcagcagagtatggcagaacaggacatgggctttggagacagacacacccaagacagaggtctggtccataatttcctagctataagcttgaggaagttatctcctagggttcttggattcttcatctgtaagatatgaagaataatttcttcaccctcaatttcctcctctatgaaatggagataatgttgcctacttcgcagggttcaaaatacatataagtgataataatgttatttactatttattcatttatccccactttaaaaaggaaaagctgaggcacagagaagtaaggtgtgactaaggtcacctagctgggaaattctagagctggcatttaaatctagcatttgtctttatgcacttacccaacatactatgtcatcttaaccaatacactaaagcatcattagatgtttccatctacagcctcttacagtggggaaacagtttgatattcaccaatctcatttaaccctcacagcacctctgtgcagtactaacatcttgctttaagatgaggaaaggaaagctcagagaaggtaaccgtggccaaaactcaacataggcccagagaagggaacaccagccaaaactcaaagagctaattagtgacagaacttgaaattagatgtagggtttatgaccacaaatataaatataagaaagagagccaactctgggcccagagtagatgcccacatctttactagttatctaggtggtatttctacattgcttttaaagttctctgatagcaaagctgaaacctggctaggtgttgtaagatagatgagaaactgcaagtcaaggtgtgagttcaatgagtggattttaactcctaacttcaggagtactggtcaattatcctttactgagtggtgctatcagcccacggtaaaataaattagatttttaagaaggtgcagaattgccactataaaatcagataagcctactgcagttgggaataaattctatcatagaaatacatcttgcctgatatcaaaggaagccaagaaaccatgccaagagttggatgaaaactgacattttctgctgtggagacagaagtggtagcactgattggagaattatattttgaagagttctaaaatatttatcatcattctaggtcatttattcatttacccttttaatgctcatttcttttgtgccactaggtcgagcttaaaagcaaagaatgaaaattcactgtgtttttatatattaatatgaagcaggaagtttctctattgcttggtttgaaaaataaaagcgtttctgagaaatattagaacactaaatgttctttcagaaacatggcttttgtcattaataaggatgctgggtgtatctaagcgtgttatgaatttgtacttttttttgtttgataacttcctgtaacttgaagtatttcaagaagggaaaaagctgataaaaactactaaaattgccattgcttcactgtattgattgccccattatgtttctttctagacttgactcaggcatctccttctccaggatgccttttctgctctccattctaattaagatggccttcctctgtgctccaggagcatttacacaaaccactatccatcactgcccttatcacactgcatcgaagctatctgcccgcacatctgtgccccctggaaggcaatcaggacaataaccatggcttatattccacctggtgtcctcagcacctggcatggagccagaactcagcaaatttttaccaaagaacaatgaattttaaaacctgactatagaatggcagaatgctccttctgcctccacgaaatttactttcaagttgaacaattttattaaaaattccattttctaatggtatcagagacctgcaaagctaaagaaaaagcaagtcttatttccaggtcagaacttatttcccaggtcctcactatttggcttatataatattaaaaggtatttttaagagtataatttctatttctcaggcttgaaggatacttttgttagtgtcctcatagctttctattttggctttgcatccagagaaatgaaagaggcttgactcagctgccgcttaatactgcacaagcctgagagagaagactattatataagctaatgtgtattttaaggtgtttttttttttcatagccaatacctaaatgccaccttccaacctcatgaaagtgctgaaccccagtgtgtgggaaagcgaggtcccctacacggctctgtattccttataagtataaaaaataaaagcagttgattaagggttagcaattttcttttctttctttacacgtacttgtaattcatttaatgcaggaagtgggctgagttttcttgttctttccaattcaactctcagggagctttcttgccagcctgctatggttaccatggcaacaaggcgatggtggcagtaatatgatctcatatgccttgtgtcaatagcatcagatcatcacgcttgaggataattttgacaataagcttcagatatagattcaggatatattaccatttgattgatttaccagaaatactgagcaattacagccttaaacttctaataaaagcatgttcacaaaggttagcgtttttccctagatgacatattatatggcattctgaaatttgtaaattgctttcatatatctgcttcaattctcattaggcaggacagatataatcatccccattttatagaagaggaagtaaaggcccgtgcaatgtgctgtgtaaggtggcaaaagcaactccacagtgaagctgaaacttcaacttgaggcttctggcatcagaatcacactttcctcatgcctgtgttaagaattcatgggtattatcaaaatgttcttagatgcataggttagaccctggaatgtctgaattaaaataatgtaaatgtatctgtgataaataactactagtttgagaatattagtattttatatttgggtgatgcttcatacattttatatctcccattacaccttcctttcctaaggcttttctgatactagatgcacaaatagatgcttatctctttctcccactgatcaacatcttgtcttttttgttgttgttgttattagtgacatttatttttccattgtgagttccttgaaagtagggatcatgttattcattcttggaaggtccctgatcctggcacagtatgtatggatctgttatgtatcaggtactgtacataatatgtaccaggtacataacagatacaccataaatgcttgttgcttgttaaactgaactcatctgacacccacaaaccccatgaggtaagtacagctggcattatgatccactattttaataaagtggaaatagaggtcatggatatatcatgggcaatttaattctttccactcccagccatgtgctctttccatgtcgtcctgtttgctttattctttcattgtttctctttcattcattaattcatcaaacatttattagttgctctttctatatcaagcattgctacagataatgggttacaaagataaataagacacaatcctcagcaccaaagggctcacagataatgcagataattttctgcctaggcaagtagtaaaataaaaccttatatggaacttcgagtatgcattatattatttcccaactttattggctctttaaaatgtatcttgagaatatgtttcaagtccctctttaatgcagtgttttagaactggataagccttgagccattgccaatatagggtgatactaattctgcatcttcgttttttttcttgggcataaaatcagcatttccaacatcccacagaatccctaaacttaacgtgtcctcaatgaaactcagtatctgacctgaacgaatgggaagtggcagaaagaggcagatggtcagggtgagatgccagactctgccgtttgatatgacttagggtcagttacaccatctaggggtttcttcattagtatctggcacgaaacacagtgttcaaaatacttcttaaatgtattaattaatgaatgagttgtcaaagaggatgaaaaatgatgacataaaatagggatacctgaagcagtgttagcattagcaggtactcaataaacatcttttaaagagtggactaaatatatacgattcaattccccttcctgaaacatattaaattgccaagacaaaacttctaagttatctttatgtctctttccacatcatagagtcaggtttatttcacctctgcaatgtcttggacttgtgcctttctcttcatccaatagcatgatttgatccaacccccaccctttcactagtagactctcagagaaggcccttgactgaacttcctctctttccagggtctcccattccaccttactggtgaaactcttatttttaaaggataactaggagtgtataactcttctggccagagattttgtattgatttgtatattctaattaagaaactttttagaatggtaatcaagatcctctaaaaggtgatctttagttatacctatagtcattcctttccatatactctaggttttagcttcccctacacacacttttggacttttaagctttcttcctgtattcctagttagtggagtaataacagctttgtaatacttttgcacaacactttgcaatttgtaaggaactcatatatgtttataatgaaactttgtgataacctcagagtaggtggatatgatcattttcatttcaccaattaggaaattgaaaatcagagagttaaatcatacagattctcataacctttatgagaattctattggaaaatatttgtgtctatgatgattgtttaaccatggaatacttgaatcaaactctttaaattaacaactgtgacttcaaaatgctaacgattgacatttgttcagctcgttagcccagaggctaatcatgatgcttttcttctgcatagcaaaagaaactatcaacagagtaaatagacaactacagaatggaagaaaatatttgcaaactatgcatctgacagaagtctaatatacagcatctataaagaatttaaacagggtgggcatggtggctcatgcctgtaatctgagcactttgggaggcggaggctggtgcatcacttgaggtcagaagtttgagaccagcttggccaacatattgaagccccatctctactaaaaatacaaaaattagctgggcgtggtggcatgggcctgcaatcccagctactcaggaggctgaggcagaagaattgcttgaacctgggagatggaggttgcagtgagccgagaccgtaccactgtactccagccttggtgacagagcgagactctgtctcaaaaaaaaaaagaacttaaattcacaagaaataaacaaataactccattaaaaagtggcaaaggatataaaccgatacttttctaaagaagacatacatggagccaagaatcatatgaaaaaaagctcattatcactgatcattagagaaaatgcaaatcaaaaccacaataagataccatctcacaccaatcaaaatggctattattaaaaagtaaaaaaataacagacgctggtgaggttgcagagaaaaggcagcacttacacacgatgggatcataaatttgttcaaccattgtggaaagcagtacggtaattccttaaagagctaaaagcagaactaccatttgactcagcaatcctgttactgggtatatacccagaggaatataaatcatcctcccataaagacacatgcatgcgatgtttactgcagcagtattcacaatagcaaaaacagaatcaacttaaatgcccatcaatgacagatggaatgaagaaaatgtggtaaatttacaccatggaataccatgcagccacaaaaaagaacaagatcatgtcttttgtgggaacatgatggagctggaggccattatccttagcaaactaatgcaggaacagaaaaccaaataccacatgttctcatttgtaagtgggagctaaattatgagaactcatgaacacaaagaagagaataacagatacttgggcctccttgagggtgatggttgggagaagggagaagagcagaaaaaataactattgggtactaggcttagtacctgggtgacaaaataatctgtacaacaaaccctcgtgacactagtttacctatgtaacaaacctgcatatgtaccccacaacctaaaataaaagttaaaaaaaaaatgatgttcttggctgggtgcagtggctcacacctgtaatcccagcactttgggaggctgaggtgggtggatcacttgaggtgaggagtttgagaccagcctgactaacatggtgaaactctgtctctacttaaaaaatacaaaattagccagctgtggtggcgcatgcctgtaatcccagctacttgggaggctgaggcaggagaatcacttgaacccaggaggcagaggttgcagtgagccgagattgcaccattgcactccagcctaggcaacaagagcgagactccgtctcaaaaaaaaaaaaaaaaaaaaaagatgctcttaagctggattgcctgtgtggaatcctggctctactatttcctagctgtgtggtcttggatagattacttaatctctctgtccttcaatttcctcatcattaaactggggataccaatagtttctattgtgtaggattgctgcaaggattagtgaattttatgtgcgtaaagtgctaggataatatctgacacatagcaagcactcctaaatgttgctacccttaaagacacaacctaagaacttctttggctagtccctggtctgagaaggaaaatcaattccttcctcattggtgctaccttgtttgggtcttctatactggggacactatagctgcctcagggtgttggctcaggatagattcagaatatctgaatctacttattgggagcagtcactgagtttctctaagcctcattcaccatctgaaaacacctggataataacagcattttacatcataggattgtggtgatcattttattaactagtacatataaggcatctagtgcttggcatggagtaactaatcagtaaaatttagtgactattactgttacataaatgttttgcccatgatattttgaccttcttgggttaggacctgtctttttcgttatctttatgcctatctttgttgcttcttcacagtagatttaaaaaaaataaacatttaaataaaaaagattttgcttatgagtgtcttggctatatgggctcttttttttgttccatatgaaatttaaagtagtttttttctaattctgtgaagaaagtcaatagtagcttaatggggatagcattgaatccataaattactttgagccatatagtcattttcactatattgattcttcctctccatgaacatggaatgcttttccatttgtttgtgtcctctctgatttccttgagcagtggtttgtagttctccttgaagaggtccttcacatcccttgtaacttatattcctagatattttattctgtttgtagcaattgtgaatgggagttcactcatgatttggctctctgtttgtctattattggtgtataggaatgcttgtgatatttgcacattgattttgtatcctgagactttgctgaagttgcttatcagtgtaaagagattttgggctgagatgatggggttttctaaatatataatcatgtcatctgcaaacagacagtttgacttcctctcttcctatctgaatacgctttatttctttgtcttgcctgattgccctggccagaacttccaacactatgttgaataggagtggtgagagagggcatccttgtcttgtgcccattttctaagggaatgcttccagtttttgcccattcagtatgatatgggctgtgggtttgtcataaatagctcttattattttgagataagttccatcaatacctagcttattgagtttttagcatgaagggctgttgaattttgttgaaggccttttctgtacctactgagataatcatatggtttttgtcattggttctgtttatgtgatggattatgtttattgatttgtgtatgttgaaccaaccttgcatcctagggaggaagctgatttgattgtggtggataagctttttgatgtgctgctggattcagtttgcctgtattttattgaggattttagcctcgatattcatcaggaatattggcctgaaattttattttcttgttgggtctctgccagattttggtatcaggatgaggctggcctcataaaatgagttagggaggagtccctctttttctattgtttgaaatagtttcagaaggaatggtaccagcttctctttgcacatctggtagaattcggctgtgaatctgtctggtcctgggcttgtgttggttgctaggctattaattactgcctcaatttcagaaattgttattggtctattcagggattcaacttcttcctggtttagtcttgggagggtttatgtgtccagggatttatccatttcttctagattttctagtttatatgcatagaggtatttatagcattttctgatggtagcttgtatttctgtgggatcagtggtgatatcccctttatcatttatttaaatacaaaagatttttcaataaaaatgattaaagtagcaggatagaacaatctttgcagagaaaatcccaaactctaagtggatggatgctgagactgtatgcaaaaacgctaaattctagaaagagttaaatttgaaaatatctattcttattacaaaatattgatctagtggttgttgggaaaatataaatgtaccatataataaattgggtttggattattaaaattctattaccttgtccacaatggaagcaagaatataaatgactttataaaactaaaaagttttaaattttcttctgtacattggcatatctcacaaaggaatggaattggttacactgcatatgagaacattttgatgcagtataatcttttattgtgcagctttatatagcaccctttcctgaaagagtgactgtacagcgcctggtgttctaaatccagtcgctaactcaaaccttttcactttcataaagaggttttgggaatgaagttaatattccatttaccaaactaaaatataatattatgtgctgcaatgctgtgagcccacccacccaccagactgcagataatcttctattcatatgctcaaatcaagtactatgcatatttctagctcactatcaaaagtaactgcacatatacacaaagaaaggatagaagaaaatgaatgagcagtcaaaaatgactgcaggcgactttaacaatacaagatcagccatttttgacaaatatttgatttgaaattcactgatcttctattaggactcaagggctggcaggagtaacgaatttcctgagcttctcttatgtatgttcagaagtattggatcagtttttggtctcggggtaacaacaatagcagcaaaacagtaacagcaaccaacatgcactgagtttacttcacaccagcactcaggcagaacttctgcttcagcagggtgaataagagcccccaaaggtatcagatcctaatccctggaacctgtaaattatgccttattaggagacaggaacttgcagttgtgattaacttaaggatcctgagatggggagattaccatggattatctggatgggccctaaatacaaacacatgtatcttataaaatagatggaaagggagctttgacagacaaaagaggaggaggcattgtgaccacagaggcagaaattggagtgatgtgggcacaaatcagggtatgctgacagccgccagatgctagaagaggtaaggaacatattaccctctagagcttctggagggaatgagcccctgctgacaccttgattttgcccaagtgatacttattttgaattcctgttctccaaaacttggagagaagataaatgttttttttagccagcaagttcatggtaatttgttacagcagccatgggaaactaaattaagcatccaaccattgaactaatatactaatatattgctgaactttggttcattccttcataagcctcccaaattcttgatttctttgttctgtgggggctgctgctggtaagagtagagctattaaagcatccttccatgtgaagcatcacctgctgacatttttgcagaatcccttccattgtcagccctacctacttacaagttgaaattgacacacaggtgcagtgagtcaaggtctgacttgaatgctttgcttttctctcagtagattttcttaaattcagcaagtcctcacttaatgtcatggataagatcttggagattgcaactgtaattgaaactatgtataaagaaaccaatttgaccacagtcaaatcaatataaacaagagttcagttcctatggtatatttctggtcaaagaaagtaatcaccaaacttctaaataaagaagcaaatacttctaatattaaacatcaaaataaatgggagctatacatacatttaagaaatattaatgaaaaggaagatgatgatttacccaattattccagttcaaggtcgcctgtcccggcaactcagggcaccaggtgggaacgcaccctggacgggacaccctcccatcgcagggcatactcacacccacattcgcactcactcagactgggaccatgtagacttgccaattcacctagcattaagcacatccttgggccgtggaaggaaaccggagtgcctggagaaaacccatgcagtcatggggagaacaagcaaactccacgcagacagtgacccgggctgggagtcaattttttttcttatcaacatcataaggaaacagcattacaggaaatggtgtaacttgaggacttgctctatagaactacacatgccattatttcagtatgtttcttttcttgtttgatctcattcatttgcacacttgaatccaccaataattaaaaacatctgtgaatataatcaatacataagtaatgaatttattgtttctttgggccagaaaactgttaagaacttgttatatgcaaggcattggtttagaaaccagatattcaatgataaattcttgacctcacttaaattcttattgagatgaaaagaaatattatcaagtcacaaacagtacaaagctgggtgtgaaaatgccataaggagaagatggagacaacgctgacattcagatttctggcttaaatgactgaaaaaatagtgatgccatttactgacatgggaactgcaggagaagcagcagatttgggaagagcagtggatttgaggtccctggggggcatccacgtggaaaaacaggcctgatgttaaggagagagaacttagaggttttgaaattatctgggcattggtgataattaaaatcctaggaatggaactcattgctcctggacattgcataatgggagaagaaaagagaggcttagaaaaagtacagggctagtaaagcgtatcgcatattaagagaatgatgactaacctaatttgagatttaaagggatctgataggagataaattaaaaatcagttgggtctatccaaagaggataaccctatatgccagcctccaaaatttagactttttttttttttggtcatatgtattgagtcatagttagaggttttaatttggggactagtaggattatagctatgcttataaggtaaatccagggtagtgtgtaggatggacattagagagaaaagacagaggctgaagagttgagttggaatgttaatgtgatgatctagaattagaggtaatgaaggcctgaagaactgttttaacagtgtgtgtatgtaggtatgtgtgtgtgtgtgtgtgtgtgtgtgtgtgtgtgtgtattttccccccaaatatactaaataaaattggtatcaacatttcttatcaacactatagggaaacagcattaaaggaaattatgttacttaaggtacttgaggtttgatgttcactcaaacacttttgagtatttatttctgcattaaaggtcttgcatttcatacatacaggtgaaaaaagaggaaggcaagatgtcaagagaaaaaaatgtggcatatggcctgacccagtttatttgttgagaactttgtggaagcaggatcagtaggatgcgctgcgatgtatcctggcagtggagaggaaagttaataataaccatagccacgggatgaacagtggctgctcactgagtgttgctaagggccatcaagaggtgaatgaaaagaattatccttttgttcccttcatggagatgctggcaaatgaactgaatttaactcaatgaaccacaaagcctaagggtaactgttttcctttgtggtttgcttattgaaagtcactgctgagctgatacgggtgttggggacaatgtctttgaccttggagttcttaaaaccatcctcagactcaatgaacagttggtaaggttttaggaatgtcctagcaaaagcactctggattctgcaggcaagtgggataattcctgaagtattattttaaaaattgtgtgaaacagtggaaatacactatttggagtcagatagatgagggtttgagtgccatttctatcacttggtgatcctgagaaaatcagtctccttaagccttaggcaaaatggggataatgatcgattttgtgaaaatgttaataaaataatatatggaaaaataatatatttgaatttatagatgagacttaatagataaatgtgactgccctcccatacttaaggtcactaaaaatattaattaagagtatgttgaatagaagaatttggaaaagaaaatcaagctagagagaatgggagaaatttccttaagaaacaaaacataaaattttattaggactatttgatttgcttaactgaaactctatcaaaagccattttctggtttttacatgaatcttcaaatatttctaatcagcagtttttctcttaactgccactcagcttttggttggatgatgcagagatgtaggtgtttcgagtaactaatacaattcccttctagggtatgttgcagggtgccttaacttactgtgtatgcaaggtaaataactcctaatatgagacaacaaacaaaatacatgtctaatcaattcagaaaaatgtttaggaagctccataaacatgttttcataaacgcttgctggcagccaacttgcctggctttcagagttgctataacaaccagcagtcctctcagcagccttggcactctgcattcttacatcttttaataagaaatatcattatcttgtctgggctcattagctcaattatttaaagcatggtactagtaaagccaaggtagagggttcaaaagtatgcattagcaagaaaattctatccatgtgtcctttgccaaggcgacttgttcattcattcattcatttaaaaatatttattgaatgtctgccatgtgccaggttctgttctaggagctagaaataaatcagtaaaattaaaaaaaaaatatatatatatatataaacatgtatataaaccaacaaaacaacaacaacaaaaaaccaacaaaaaaaccccaaaaaaacaaaaataattaagatgccagttttagtgatgtctatagtctggtttgaggggcaagaagggagacagatgctgactaagcaacaaattaatatacatgtagaaatacatgtagagtgagaacaatgaagacaaagcagggaaaggagacaggtgctgtgttagggtgaggagaaagtgcctcttgatatggtgacattagagcagagatttcgatgaattgaataagaaaagctgtagctaagtcatggaagaacgttttaaacagaaggttagcagggcacaagctctgaggtgagagtgtgcttggccggatcaggaccagccaggagacctgtatgactggggtattagtcagggttctctaaagggacagaactaagtggatagatgaatatatgaaggggagtttattaaggagtattgactcacaagatcataaggtgaagtcccacaataggccacctgcaagctgaggagccaggaaaccagtccaagtccccaaacctcaaaagtaggaaggtagatagtgcagctttcagtctgtggcctaaggcccgagagcccctggcaaatcactggtataagtgcaagagtccaaaagccgacgaatctggagtctgatgtatgagggcaggaagcatagtacaggagaaagatggaggccagaagactcagccagtctagtcctttcacgttcccctgcctgcttttatcccagccacactggaagttgattagatggtgcccacccagattgagggtgggtctgcctctcccaacccactgactttggcaacaccctcacaaacacacccaggaacaatacattgcatccttcaacccaatgaagttgacactcaattgtaaccatcacaattggagtggagtgctcaagggaagaacagaaggtgatgaaatcagacaggaagagatgatctgtccatgcagggtcttggaaaccactgtaagggattttagattttattctgagtgagacaggaaacgaatgcagagttctgagtaaaggggtaatataatctgacatctactttaggaaaaattgctttggatccagagactctacgtaggggctcaagaaggaaaggggatctgttaggaggttattgcaattaaacagaggagaggtgatgacagcttagagcaggtgccaaggatttaagaaataatcagactctggatgtttttagaggtagtgccagtgggatttgctgatgaaataaatgtgaagtttttctcttgagcactagaaaaatgaagacagcatttccgccctggggaagactgaaaaataaaagcatgcacaaacttatttgtgtgcatgtgtgtgtgtgtgtgtatgtgtgtaaggcagaatggagttgtggatgccttaatgttgagatttctgtgagacatctaagtggatactttcatctaggcaactaaatgtaaataataaaatctctttatagatttcagagttcaggagagatgtctgggctaaagatacaactgtaagagtcatcagtttatagatgtaatgtaagccacgggtctgaataaggacacctaggaagtaaaaatgatagagaatagaacacaaagaactgagcctttgggtaatacaatgttagacttgggaaagataggggaggggcatccaaaaggagagaatgagaaggaatggcctgcaagatggaaaaaccaagagataatgggggtattggaagaaaattaattcaatatgaaggaatttatcagttaagtcaaatgctgatgataggtcatataaaatgagggctgagaattgacaaattcggcaatgggaaagtcactgatgactgtagttagatcacttttagtagggtggaaaagagaaaaatttcctgttaaagagagaatagaggtgaagatggtgattacaagatcttttgggaggttttgctataaagtgagctgaaaaattggacagtaactgggggtaatgtagggtaaacagaattttaaaaattcaaatgaggacttattgtgacatgtttgcatgctgatgaggataatcgacagagaggggaaaattgatgatgtgcgtgagagcaggggtagtgaagcctttgagtagacaagaggggccacatagtttaaatgtgggaaatttcattcattcattccaaaaagttaagcaaacatctaccatgtgccaaatacacagctaagtactaggaacacagaaatgaataaaacatggttcccattatcaaagaagtcatttctttgggagggagaataagcattttctctaattaataattcacgttcaatgcagtgatggtaatgtcagagaaatgtacccagggctcttttctgggatcttttcattacagcatgctgaatcttgggctgccatgtcattagaagcctagattcaagaccttcatttccatcatgcattgacatgttctgggctgtactactgatgagactgatttaggcaagagttctgggcatgaattggtgctgtggctgcacagataaagtcgaggtgatagatttgagaactgtgtgctaggtaaatcagcaatcctggtgattggttgacttgaagtaaggtaaagaagagggaggctcaaggataactcctaggtttcccatatttagttttatcctggaagcgaggatgctgataaacagattcctaacaggtagcgtgggtggataagaagaagaatctgggcccttttcttaaaaaaaattaaggtctgataaatacctgatactttcaaaaatatttgaaagcagccagatatttctgtctataaaaagaaaaaaaaaatagacctgatctctataggatgtcacaaacgctcaaaaaataaaagataggaaagactaataatacaatgctagaacactttttgatactacctaagagacttaagaaaaaaaacaccaaacccccaaaacacagagttcttggtatgatgtatttgtttttccatagaatggtttgagaaattcagtgaaaattaattggaacatgtggttgtcattcacatggttccagactttatgggcttaataaaaacattatgaatagtttttggagttttgggagaagcgaacatggctggtctaggtatctgcttttaggttaatccctctacgcaggaagtttcacagtgtcatacagtgcttttcaatttttcccactcaaatgctcccactatcagagggatgagaatgagcttccctggatggcagaggaagaaagggggtagggtagtctgagggtgtaacttgaagtttcaagttgcaaacataaagtttcctttaagtctagtatttcaatttaacagtttagcaaattttctgtgcaattccgtaaaatattcatttctttcatatagaaataatagagtctccccctccccccaccttaccctgctctgaatcactgagtaaaacctatgcatggcgaagatatgtcatgttttatctcatgactttgattgcatccttgtatcctgtcacaaagcaggggaaggggaaagacacagaaccaagtttcaggaggcctggactcttctacgccagttcgacatttattttttaattttctttgcactctacttatttccaagaggagttttggagttgctgtaagacttttagaaaatataaatgatctgtgccttgatttccttatttctaaaaacaaagaagttactctacatgatctctatattcccttcttatcgattaagagtctacccacttttggtccaagcaaaatgttaacagggctagtggatggtggtaccaaatgtatactggtaaccgatcaattaacattttggaaaaaatggaatattcagctaagatttgagtcatgatggaaaccttgaatttaaaaaaaactaaccttgggagattattagaacttagaatccacatatttgacatgtgctgtaaaaagaggttatttcttgagaagtagaattgcaactttctgctgaaaaaatatcaatcctccaaggcatcctcagtaagcccacaggcaaactcccacctcagcagactgaataatttgcctataaaatatcacgttgaatttgggaggctgaatatggtgggaaaagtttcatgtaggagaggacctgccctggagatgctcgctgaggtggcaaaggcaactggactctcaaagtagtcctccgtttaacaacatccctttctcaggtacttctctcatctgcccgattacttttttttttaaagcctgacaggaatgatgcttccagattctgagatggtaacaatgatctaaatagactgtcatcatttatcagcattcacaaagagaaaacagctatgaatttccagtgggaaaaaaaactttagaatcaaaaaagcaaaaggtacataatgctgtatccagtgaaaacttataaaagtgtaatgttcgctttaaacacaatacaccaccctgagagggttgccttcagtaaggaattgttttcctctgggaaggaaatcactggcaataccaaatctataaggagtgccttagaaacttggctgcaccaagggccgtgtagttttgggaaaactcagcctgttttctttgtctctagacattttttagacttgataatccctcacatgggtgttggggtgtcttcaaggtctccaactctgtgctgtacttcgatcagcaaatgcttggggagaatttctgttttgattgcatctgccatttgcctccacaaattagacttttttaaataaaatgtaatccttttttgctgagacaaggatgaacacaatttattttgaaaagatacataaaatgtattataaaagacacaatgtgcaaaccagaaattgaaaactaaaaacgaacatcacctacacagaaaattctaagttcttaaaccagttggttgaacgaccttgggcaagttgtttaacttctttgaatcaatttcttctttatctgtaaaataaatacttataatcgtttcaagaaagtttattgactagaatccctggagccattcaaacagattcatattagccctcagcgtggctaatggcttcatctcaattctaagtgcggcacatactttcttgaaagtattgttaagtatttattttatagatgaaaactggttaaaaactacacagtagctgcatactgtaatggattctgaaaaggcctagttcaaactctgaccttctataaataacattgtggcctgccatatgaaaagacagtattgctagtgtcctgttgctgcatgggtgatgaaattaggacacggaccatgaatgagttgcctgattctgaatcagactatcaggcagtacagaaggatgccttcctctaagagttcattatttcctattagaatgctgtgtgtgctgcacatagaattgaggtggagcccttagccacactgatggctaatttgaacctgtttgaatggctccagggattccagccaataaacagaaacttgtctgttcatctgtacattcctctcaaattggttgaaataaatcctcaacacttgatgtttctgacctggttcacagatactcaggagcagcctgtggtatagcattatgagaaattttccagtctgttgagtagaagtaatccaatcctgtcactgtttgtggtagaaaggagagagaatatagagatgagatccaagaaaacaagaaaagttctgaggcctagaagaagtggaattctgtggcaaaaagtctggagaaactgaatttgagtttatggaaaaagccaaaagacagaacatcctggagaatagagccactctttgactggaagcttggaggatgattgtgagtagaatggcctatgtctaattctacatgcaggaggatggagcaggtggggccgtttcagggccaggaaagggtctcccttctactggactgggatgaaacaagagccaaggaacaaattgagttgcagtagcagatagaggaggtccagtctgagggtaaagcatggtgtccaagtagcattcagcaatggcagagcataaagtagatagttccaactggtagcccaagataaagaagcattcaaatgtatgcctgtggatggtgttcccttcccacaaggcacagaggattctgggtcaggcatcactcagagttccagagggaagggtatacatctgtcaatgcatagcaggtctcagttattcagcccaaagcaaaccattggctaaaacctttgataaaaagaaatgtgacatgtagcatggagggtggggcaagactgaggctcaggaatgggacagggcctgtcagaattaccagaagtgaggcagcaccacaagactagatcagcagcaagagttatttgaggtgcagtcacaaaaggtgagttagaatttaaatacatgccactttgggtctgatttggtcttaagtgtgtaggccaaggctcagtcttgaggtagagcatgatctcatttgtggtaagttgagagtatgctgaaattcagcatgaaaatggagatcagagatcctccaccttgctgtcagtctagacagagactgaaaaactgggttaaaactttaaagtctttatatcttggatatggagataaacaaggtaatactgcctggataaataggggaagaagctatcaaaatggtattgatctttccatttaagactatctattaccattcatctcttcaacatttgaaaagatgttcagtataacattgggattttaagtgatgattgtatcaaaaaatgataagtttaaaacattttaaacttatcagtgcacaagaacgggatgaatgcttatccagtatttctttctgtatttattatttgagtaaatcatgagtaataggttggtcccttatttaaaattttagttatggtcaattttaagaggaacacaataatctttttttttgtcttctgtacagttatatcaattttagcagtttggtgtctagttttaccaatgctattttatgatctttgccatttgccatggtacaatgtgtttaaatggcacatcaaggtatactgatggttgccatttgcttaataacttaaaagtaatccagcaatttcttccacttttatttcttaacatatgattttgttttgtgaaacatgaaagatgagtcttatatttaggaaccatttggttgggaagctgggagagtaaaatttaattgattttttttcttctgcagctcttgaagaaatagcatgtgaatccagattaggtggcatcatgtatatttttgtaaaaggaatttttacttgcttaggctgaattcatccttataagcctccctcagccatccttaattcctccctttctctcactcctgaagtcaaggattactatgttttattcctttttctgctgcaatatcccggactcttctctgtccatcactatagccacatcagctaataagctcctcttcctgtgtccttcttccctctctactcatcctctatagtgccatcaaagtcagagtattaataaacaaatcctgacatgtcagtgtgcttactccccacattttgaacggattaagttcaaatgcctcacaggatggcatttgaggtgctgatcctaatttatctttctaaccttgtttcttgcctctttcttccattcctcacatgcaaacactgaactccagtaacaccactttgtcttctcaacatactctgcactattgtgtcttcatgccccttggtacatgctatttcctctgcccagatattcttcctgggcttctgtacctgttgaccccttcaactcatcctttaaggactggttcaaagaccacttctgtgacatcatccctgattcccacagagttaaacaagacttctatgacacgccacagcatctgaaatacatctgtgctggaaacttctactatattgccttgtaatgatttgttagtgaacctctctcttccacttggtctgtagctccagaaaaccagtggctgtttgttgcctactcgtctttgctttattcttccttctgcctgtccacctgctctcccaacatccaggggccaggacagtccctggcacacaatgaacacccaacaaacacttggtttaagcaatgaattattatcttgcacgagatttcatgagtctctttagttttgctttcttaacttacttaatgcttattaagatgacttttcactttcagttcttcctgtttgattccagttcttagtcatgtcttccccttggcacaaaactgattgagcaatatatgctgaagcctcactcttcaaatttcatgacaaagtctgagggtcccaggactttggccaagcacaaatagtaagtgtctgggaggcatcaactaaattatctgccagtgaaaatgctctgtcttctttgtctcagttgtttatgcagaacaaccaaccgttcctgtaaagttatttttcctaatttttagcctaaacttttcaatagatacaggccatttctccctgtctcctcctatctcctcatcttctgagactgtaaattatcctgtaacttcatttataatgggaacatatttattttctgtgatgatggctcccctgagcctttctttttcttagctacataaagttaacttcctctgtggcaaattaaggacagattacaagcagcctgggaaccgggctccgtcaccacagggggccgcctactcagcctccttctgttcagccatgggaaagatgcagctgctaagccagccgggtgctgggctgctctccccctgcctctcctgatccctcggagggagttgagaagtccctttctccatcagtctctggttggtgtctgatgctctgttttctagcctctcttcttctgctcctcccctcccccagctgcctaccaactccttcccacccccaggccagcagtgactgcctccaagactccccctccttccagcaccgcctcatggtttccatggcaacagaaaatgttggtgggaagcaaaaatgctgaactgcaactcgtgttggggctgggaggaggaggtgaaatgtgggcctctctggaggctgtagaaaggtggggagaaagaagccaggtgagaagccctgagaagaaaggaccacgaggctcgaaaggaaggtgcattggcaagcggggatcactttgatcagaaaaatcagctaggaggaagaaataggaaagagttataaaaagtaatagagaatcctgggccgggtgaagtggctcacacctgtaatcccagaactttgggaggctgagatgagaggactgcttgagcccaggagtttgagaccggcttagacaacatagcgagaccttgtccccgccttcaaaaaaaaaaaaaagtaatgaagaatcctatatatagtggttgattgagggattacgttaggtataaaactgggaataggtgactttatattgaaggtgagtagtgaaagtcaacaaacatagtggccaaaaaaaggggggcttgagagtttaacaataatatacatacatgaaaaacaaaagtaatattaacagatctgggcttgtaaattaactattgtccttacttatcagccaagtgttacttatcttctctgagccttagtcttctttttgcttgtctattaatatagtgttatcaatatccacctcaaaaagttgttgtgaggatcaagtttaaataaagcacataaagtggccactcatatagcaggtaaggtaggaatttttcttttaaccattgtatgaggttgaggaatggtacttcaaatgggtcttggagctggaaacttaaaattcattgaaaactgtgccttgtcatatatttgatttttgtatttatttcaattttccatatctcttaagtatatggcaacatggtttttttttttcttttttttctttttctttctttctttttttttttttgagacagagtattgctctgtcgcccaggctggagtacagtggtgcgatctcggctcactgcaacctctgcctcccaggttcaagcaattcttccgcctcagcctcccaagtagctgggattacaggaacatgccaccacgcccagctatttttttgtatttttagtagagacagggtttcaccatgttggtcaggctggtctcaaactcctgacctcaggtgatccacctgcctcggcctcccaaagtgctgggattacaggcgtgagccaccatgcccagccagcatcatgtgactacgtccctaagtacatagtaccatggcaatatttagtgttaaccccttcataaaaaataagaagaaccatcctttccttttaaataacctccctgtctgtgcttttcaagaagcctgtggtgttgactcattctctctcctttacagccacaatattgttggcatcataacttctcatttcttttctctctcttcagtgaaaggggttgctgcagaaattatgttctaaacccacaatcatgtttataatggtccacgaatattttttgactgaatgtctgtgtcatcacttccttcagaagtccaaggcaagaaaagctaagaagttgtggcccaactagagatgcccataagcctatttactccgggctgtctctttgcaatcttagaagatgtcaagttactgcagaggctctacttcatgcctccttttcctgaaattgggacaataatagcaacgatgataactagcgcctgaacttgttgttccaaagtgcctgacatgaatggaatcatataaacttcaactcaacccaatggaattagcatgttgttaccgtgacggtttccacatgtggaaactgaagcacagagacattaagtaattttcttaaggtaatatacctcgtaagtttcagggctggaatttgaatctaggcagaatctacctccttaatcatctccactgtgctaccctctagggaagaaatatctggaactgtggcttgatgatattactactgctttttatagacaacgatttttttcctcacttggtatcatctaatgaataaagaaggaacgtgttactgtacttctatttcaagatgtgtactgagcccattggtttatcttttttctcctcttagatcccagtaaaaaaagctaaaaaaagaattcatgatctaacaataatgaggataattggagaaaagctatatggatctgggagatttcaataaatttccagaagtcagaaagagcgtggaaagatgatgcagtggggcagaggtagctttgggctagtgtgtttgcagagggtcctgaatcaaaaaaagagcccaagttgcccatcagaacctcggaagtttcagtctgagagaatggagatgggatggaggaggagatagagaagtgagtagaaaatgaggatgaatttaaaggtctgtgtattgaacagctgcccacctgcctgtaacacacatatccccaccccaatctctctttctctctctgtttctctctgtctctatccctttctgtctctctctctctctctcacacacacacacacacacacacacacacacacacacacacacacacacacacaccaggcatttaccctccattctcaggtcaaaaaggaagtaaggctaactctctaaagacattttaaaaagcctttctggggagagctggagcaactagtacagtggtgtttgggacaccctgatcattatagggacattctgctcaccacaacacaaaacctggaaattaaaaaaaaatgcacacagaatttccagtttgcttttccattgcctcttcctgaaatatgaacagaaaatcacaaactacagtcattagaggatagcttttagcacgagcgacaaagatcaaatgggaaataatgcacagcagaaaaactaactcaaaagacaattccaataatctcaatataaaaataactaacctctaactggtgtttctaacaggttcaaaacaatacatcagaggaaaaagaaaagggtgccaaaaaaggaatagagaaaaagagccttgagaaattgaaaatattattgccaaaattttaaaaatctatttaaacattgaaagcaatctcctagagtgtaagatgaaaatacaaagagttggtaaatgtgagcacaaggataaaagacatggaggaatgatggaagaaatccaacacctgcctaggaagatttcacaaaaaaggcaattgaaacgaagagatagatagaaatgatcaaagaaataatagaagggaatttcccaaaatgtacctttatatttaaagtgcctaccaagtgtggaacaggatgaaaaagacacccactcagtcacatcttagtgacacatcaggacactgaggataaagagaagatcctgaaacttccagagagggagaaaggtcaccgataaaagaaacaacgtcagactcctcatcaaacacatcaaacactgtaagacaagagagcattgtcttccatactcagaaaaattacatccggccttgaatgacatactaagccacgctattaatcaaccacaggggcagaatatgggcatttttagattcacaaagggttagaaattaatctttcatgtatttctcagctgtttcttttataaacagttatttgaatgtgtgctctggcaatatgaaaaatgacacagggaggaaagcatccaagaaacagtggattcaatggaggactgcaatgaagagagtcccaaaatgatgaatgtgtggcagtctcagagaacaggtccagcttcggacaggaagactaaggattaatgtgtggcagtctcagagaacagcccagcttcggacaggaagactaaggagatgggtcccaggaaaaatgtagatcagaaaaacagatagtatgatggagactatgaaaatcttaaggataaagtaaagataggaaatgcaagatgaaggaaaagtaatcagagatgacaggaaagattaaacagggttaaagattaaacaagattaaaaaaggtaagttctaggataactctaatgttcccagtaactgtgcaaatgggtgtaaccatcattatcatgggtgccctgcctctcaggacccaggtatggggttttcattcttgatacggcttcccacaccccacgagttggcatagaagcagagaaatactttcaggtcccaatgcaagcttggatgctgaggacttcagcagggaccaccatacagtacagatttccctgtgtgcctggcagcactaaggtctctagtattatggggtgacaacaggagaagccaatccagatggcaatggaatttcatgctggctttgccatggagtaaaaactaagttgacttgaaacacacacacaaaaaaattatattttgtcgcacttgaatttgtgggctaagattcagtttgcaactgtagtgtgggtagaggaattaggagagagaagagatgatagtattgacaatgtaaatcctcatctctcacatcagaatgtcagtaaataatatctaaagttgataaagccaaaattaagggcatttgcatgttatatggagataaccaccagaaggactaagcacagaaatattgaaagtatttgcttttggagagtggggctgggaacagggagaagaatgcaggaaatggtttgtattaaagttttatttgtatatttgtttgaatgcttgaaaattatatatgtattatttcattttttttaaagtgtgctcctttctgtcaattttactctccttgctacagtgtagttaagttgtccttggcatcattgttcctgtgtctatgtagaccacctgttttggaagaaggtgaggttatcaatcaaacggctaaccagtcacaggcatctactcattcacttgctaagctccttcctcattctcgtttccaagagtgctttcaaggacacaagagaagaccctatttagtgctgtcattgtcttggttgtgcggtaacaggaagcagagaagccttaatttttagcatctagacttcagctccaaatactgccattgaaatgggaagctctgattacagcttctaaagtgcactgttttctctgtgctacagaactgtcttctgaattagtatcaataaaacgctttctaacaggatctttgacaccagaagtcaccactgatgccaatgtaattaccatccctggacgctaggccttgtcaggcagcacagataatcacctacaaccaggggccaacgattacccagtcagtcaacgacattgactgctcactgggaggttctgcacgagtaagagagaggagaactgcaatgtcctttcctcaaagtacttcaaactaaacagggctgagggtgtggaggggaaggaaagcagagattcacacacatcaaaagacagaaataaacaaacctatccattctcagttacacagagagggctgtggagatctgagttggcgcagaataaaaatggacttttgcatcgcctggcccctgtttggtaaaaacctccttggttttatgtatttcctcttttcattttttttaaatggtgttatgtatttcctcttttcatttcttcccctgcccactaactgggctcaactactgaataacccctgtgtgccatgctttttctgtgcttccatactaattatatgctgttccgcttgcctgaaagctgttcctatcactcagccctttcagcttgcaaatttttctaatctatcaagaggtaaacctgacctcttctgtggagccttgcctgattcactccattttaattccaatcagttacagtgctgtgagctttgtgagaggagggacagagtatattatcatttgaaaataattaaaattgttaatagatgtaaaacacttagaatagtggtgcctgaaatgtaagcaaatgtgtttattattattattattagcatcattactatgatcaatgtttgtatttagaagccctagcataacatctggcatatgaaagtggaaactaagcaaatgtttctttgtttgaattcttggaacatttcagacaaactgagttttattgatgagaaggttgatgggttttcttggcagtggtcattattccaaggtgaaagtgaggattattgctttagctattgcaactgagaacacagaatatcttttaagaagcagaagctctaataggtgaataaatcattttggaggataggaggatattccagatgatatgaaactattgaaaacagatttgctgttggttttcagaaaatgtactagccctcaggaagatgggcttgtttggagagatacctaatgtaacacaaataacttcattttcttcagcattatctggaatagatggttaattagtctcagacagctgtttccatactcacccgcctttgctgtctgtgtgatgtgcacgtgtgtgctgtcatctgggtgagcctatctgggcacagtgacgggtcattaagctgtcttctcatatggtgcatgtatagtgtctgaagcacagtttcaggagacaggtaacacttccactcagagaggcattacatgacccctagggttgtcaatagatccgtagctcttttgctcttcaaacactacatgcattttgacatctcaccatctttgttcattgttccattcactgttatgtccttcaccccgttctttactgcttacataaatacactcaagcccacttcctccagagatttcaccatcactccagctcatagatatctcttccatctccatcatattcagcttgctttcttctttctttgtctctccctttctccctttctctctttctttttctttctctctcttttttctttttctctctgtctccctccctccctccctcaacctctctctctctatttttctgaaacagagtttcactcagtttcccaggctagaatgcagtggtgtgctcagagttcactgaagccttgaactcttgagcttaagcaatccttgcgcctcagcctctcaagctgctgggactataggccaccatgcccagctaatcaatctttctttctttctttctttttctctttgtttttctttccttccttccttctctttctttccttccttccttctctctttctttcttcttcctctctttcctttcctttcttccttctttcttctctttctctctctctccttctccccttctctcctttctctctttccctaccttccctccctccctccctccctccctccctccctccctcctttctttctttctttctttctttctttctttctttctttctttctttctttctttctttttctttctttctttctttcaagataggagtctcactgtgttgctcagactggtcttcaactcctggtctcaggcaatgctcctgattcagccttccaaactggctgggattacaggtgcaagccactgtgcgcagccagtcatagatttctaacactaatttctccaatagttacattttatattgtgaaaacacttacattgttggcttttattaacatttgaatgtgatttgctatttgctgttaagtatgctagtcttagctccctgagtagactgttggatctttaagcagatgctgtactatggctctttgtagtttctaccacatttagcacagttagatgagtatataggtacttaataggtgttcccttaggaatgaatggataaccctcctgggatccattcaaaaggattctcctgagaactccttaacaaaggcttatctactttctagtttagactgtcaacacatgctaaaggataaaagatgcagatttgaaacacatagatttacattttaaaatgctgtggcatatttgttaatatacttcacagtctgaatgcaagtttaggttagttacccttgaggacaaagctactagactctcgaggattcaaatagtctcataaaaatcatcacaatgttatcattggtagttaagggaacattttataataagtgggtgtctttgagcatgtttcctagggaaagtgctaagtgcaatctagtccatggaagtcccacagtactctgcgaacaacctgcactacttcatggccacttcacctgaatggctcagttctttgagtgtccatgtagtcaactaatcagtctgtggtgagtaagagtaaattaaggtgactaactttccaaagtcctttaaagttatttgatttaaggtcgctgagctaggtggtttatggatatttcagtattcctggaataattcatgtaagctttttccttgtatccaatatattatgagggtaagagcaatgaagccctgtgccaatttctccatttcactggctaatcagtaattctaacattgtttgccagctaaatggaacaggcactcttgtcaccatcatgattcattgcctactgaaagcacagagctggccttaatctaattcttaataaaaccttgcgaactaggtatactgtctcaatttgcacacggaaaacagatgttcacgaaggttgagggactggcccacgatctcacaccaagtaggtaaagaaccatggaagcaattctgtgccttaaagtgcaattgtctttctaattcctgtggagcatgattgtcttttccatgctgaatctaatgattacaaatatcaaatgagccctaagcatggccctgtaatcctactccattctcctagtaaactctccttcccactctctgaaacaactttttaatatcttctctatccttatatcttctacatccttacagcattattcactagaaaacagaaaccatcagaagaaacatatttccatattctcaatgcctcatataccagtcatgatggtacccactctctctgtcttccctcctgttatcacaggaatgtccccattagcaaccaactctccacttggctctggatcccaacctctctcatctttattctttccatccttctttcttttccaatatcaatacctctttttctacctaatcattcctttcagtagccaaacatgactccagtctctcctgttttaaaaaattcttccctttgccccacaagtcaccctttagctattagtgtatttccgtactcccattatcagaaaaacttcttttgacagttgtctactacttcttctatccaatgcaacatggcttccgtggctctcatttcacagaatgtgctcttgttaagttctccaggagcctctgtgttgccaaattcagtggctacttctctagtctcatttctttttttttttttcaccttcaacttttattttaagttcctagggtatatgtataggatgtgcaggtttgttacataggtaaatgtatgtcttggtggtttgctgcacagatcaaccaatcacccaggtattaagcccagcataccttaactattcttcctgatgctctccctcccccaacccccacccctgataggccccagtgtgtgttgttccccaccatgtgtccatgtgttctcatcattcagctcccatttataaatgagaacgggcagtgtttggttttctgttcctgtgttagtttgctgaggataatggcttccagctcaatccacatccctgcggagaacatgttatcataccttttcatggctgcatagtattctatggagtatatgtactacattttctttttccagtctatcattgataggcatttcggttgattctcatttgatctctcatcagcattctacctaactgataactttcccatggagcaagtttttcccatggagcaagctttcccatggagcaagcttttggtagcattctacctgataactttcccatggagcaagctttctaaacactttgagtttgaggggtcagtagaatatataggaggtagaaaactttgcttctgttgagtatcggtgaagtaacctaaggtgaaagtgcagagtgagaagagaagagactcaagggctaagcctgagggtacaggcggaagcagggagggctacaaggaagactgagaaggtaggaggagataacagagacaaggttagaagtcaaggacaaaaagagttgtcataaaaaaaaaaaagtggtcagaatcaaaggccagagaaagatcgggtaaacagggactagtaaaagtatattgtctttggcaattgagagtttattggttgccatttataaataatttcaggatgatgacagaggctgatggtattaaggcctgattgtatttttctgaagagcaaaccagcaagtgtaggcattattttgggaggcttggttatgaagggaagaagagtaagtggatagtgtctagagcagaataagaattgaggaaggttttgaaaaaaaatcaggttatatctgagtttgctcagagagggtagagaagaaggcttccctaatatcacagcattatgcaagaactaaaaatagaatctatttcttctgcctccaagataattgagataatacatgtgtaagagtttaaaaaactataaagtacaataagaatttgatatagtgttcttctttccactatattacaattaattaccaggaagtcaatggattgcatttttaactatataacacaccctttaccccactccctgcaacaagaacctcactgctatttattcagcagttcttaaatgattgatttgttgtggatgatcttttgcttgcttccttttgaaacagtgagggatttctggatgtttgccagcctgaatattcctgtttacttgtcttaggctaacagataactggatgggccatattgttatacaggcctgatgaatgccaaatgttcagctctatctctacaggattacacctttctgaaaaaagaatgtataatataacttctgtcaaataaacttgagatacatttgtttctagtcctcagatttcaagatctcccttaagactttggaaggacaagcctaattctctttgccaggcatgaaaccagacattagcttataaactcaagatgttccataattctttcaatatgaattctaattatctttgctccttctaagagaaggtaaaagtataacaatgtgaaatctaattctatggactcaaggggcagaaatcagtgacctgatattcagaggcctatattaattatccattttatttttctcacctctgtaatttgtaagtagagttgcaagggctcttgttcttcagttactattttagatcatacactctcaaatgaatggatagttctcaatgcctgcgatgcgcttgattcacacagactagcctaggttgtctgaaatgaagtcagggagacgcatgcaatgacctgtaaggtgttgtttctgtgtctttgtagcctgagttttcttgtggataaaaatctatagccttttattatgacagctcattacaccacagaaaaaactaaactgaaagatagatcatgtcttccatgatcactgctactgtttgatgtggtgtctcctgcatgaatgaaatgactgccactcagaaggtctcatggtctgagaacaaacttgacctggaaattcatctgtatttttacaaccctgtgtatggtgagaaagtttccttagtctagactgcttaatatctgtataaggccatttttttcttctctctcacctctcttgttgatactcctctgaatcatcatccacccaagatcaaggaatgctcacgctacttttgtttgtccagggctcagatctttctcagctcactcagatatgttgccccagtatctcttattgaaaacttttccctatggactcagattgacctcagtttaaatcttcagtgctttggaccatatatttagtctttctataactaagttttgcccttgtaaaactggaataatactacatactgtgtaacatttgtgagggggtaaagataatgtatgtgataatcatataacaagttcttgataaacaatagttatattattaaattggctatattttttttctttctataaaacattacttgcctaatcatcaatttccttggagtgcttctatcaggtagttatcaagtgtaaggatggaacccaaataaatatttcttgtaagtgtgatttatttaggtactggaagaggctgcaaaataaaatggaaagagtgtagggctagaaaggtgacaagttcctggttctggtgttgccagttctcatattaaatagcagtgttatctgtatatgattacccatctatgaaaaactctaagttattagaaagattgaattcatcattgatgaaagagatccttcaggcatctggaatcttatgtaaacctcacgtagactgagtttaattcaattaaataactatttattgaatgatcattatggactgtgcttggcaatgtgggggataataaacaaaggctacacatatacacacatttattgagaactgttatgagttgaattgtgtcaccccaaatttatatgttggagttctaacccctagtagatatgtggatatagatacacatcctagtagatatagtaggatgtggccttatttggagatagggtctttacagacataatcaagttaaaatgaggtcattagggtgggccctaatcaaatatgactggtgcatattcgacatgcacagaggaagagatttgaaacacaaggagaaggtgaccaaggagataggtccagaatggctccttcccttatagccctcagaggaaccaaccctgctggcactttggtctcagacttctggcctccagaactgtgagacaataaatttctcttgtttcagccacctagtttgtggttctttgttgtggcagccatagcaaactgatatgaagacctactatgtgctagtaactgggaaactaacactgaacagggcactgttatttgtttcaggggaagaagtttggaaaagaagcagatacttcagtcccatgtaataaacctgctccaagagaagtatgtacaaggtgtcatgggaggacagtgaaggacagttgagtattaccaaaggcttgtttaaggctcctcagcagggacttctaagccaggcctttgaagtaagagtgcaagaatgagtgcaagaagcaagagttctgggcagaaaacagtgtttatatgaggcagtgtatgcaaaggcacagatatctgagcaggtgtggcactgttgtagaactgtaagtaatccaacatggccagagcttaagagcagtgaaagataaggctggagaggtgagcaagttccaggtcagtagcggaaggctccctggagcaaggggagcacctagaaccttgaggtaggtcttccttgattagcaatcgcgaggacataggctatgttaggtaggagggaaactgtaaacaaaagtgaatgcgtatatttatttggcagtgagcattctggtctggttaaagcagacatcctcttgacaagcagagcaagcaagtgagaagctaagaggtaagataaagtctctcaaaggaccagaagtatgacaaacggagtgctttgagggcagggctagtatcttgtttagtgcttgcagtatagcagtggctcaagaaacaatcactgaataagtgaagggagaagtggtgaaattctgtccttttactgaattaagcagggacttttaggttacagaggtttggttttgaaatctaggctctgctggcaatttttttaaccttgttgagtttcatcctctttatttctaattgtgagtatactaatattgaccgtattggtgagaattatatgggataatttatatggaactatatagaattatgggtatactaatacttagcatgggataatttatatggaattttatagaatatatggaactatatagaattatatgaaactatatagaattatgggtatactaatgcttacagtatatggtgagaattatatgggataatttacatggaaatatatagaacttaaaaattccatttgatcaatatttattaagaagctactatatgccaagccctgtggtaggctttaggactagaaagatgaacaagacccaatctctgcctctaaggaatttactttctgttagggggatggggaagcagacatctgaatagataaaagaactgtgatgcaatagaataaggactagcttagggctaagaacagagcaccgtgggtgcacagaggagggacagttacgccagccagacggcaggatagtgttggggaatacttcctgggggaagtgatgcttaagctgattcatgaacaatgatacgcaattaggtgaagaaggaagaaaaaggaattccaaacagagggaacaacaggcttcctttgcagctgtgtttttctagttcctgtgcctgtgcaattccttgctgaaaatatactctagtcggcttggttaaagcaaaaacaccctctctagctctcgtcagactcctgaaggttggatcgtgctctgaacagcctcagctattggctggcttctctttaaactaaacaggccttcagaaacccttcatgtagccacctgcctgatctcctcactccctttctcctgctttctttcttttcttcctgtccttcctcggtatctgctttcttcctcctctcattaaacatttcctatgtctacatgtgtaaactatgggctgtgcctggagatacaggggataaaagcatacatctaactcatgaggagctcgaaactgaaagtagggtcagcgagctatggcccattgaccagatccgcctgtttttgtaaataaagttttattggaacatgcccacgcccatttatctatgtactggctatggctgctttcatgctacaatagctgtgttgtgtagttgcaatagagaccatgtggcttgcaaagcctaaaatatttaccatctggccctttacagaaaaagtttgctggcccctgttctagtgtttatatatggcagaagtggtggggatagatggacaagtaaagaggtaatgtacccctgtaagataagtttttcaaaagggtactatagaaggagagttcctaacccatacttggagattgagaaaagaactgagagctaaaaaaagtgacaagtacgcttagagctaaaggataaaaaggagttaagagggaaaggaagatcattcttggcagagacagtagcatgtgcaaagccaggcaatgaaagaaaaacatgcagttctctattgcaaaaagaggaagcggtgaaagataaggcaggaaaatcagtttgggccaggtcattaaggatcctaaatatgaaaaccatattaaggattttagaaatgccctataatctctcccataggtaactgagaacctttgaaggattttaagcagagtagtgctaaagcaaatgtgtgctctagaaagatcactctggctgtaggatagttaacatttactgggcatttattctatgccaggtctgtgctaaacgctctttgcatttggaaatatctattgagtagctggacagcactgggaaccaggtagaaagaggtgaaacatggagaacagatatggatctatgagaaccagggatctccctaagggatgaaaaggtgtagagcaccacccttatttggaggcatgaggagaagtagaagaacaggggtgattgcaaaggggagtatactgtcatggaacacaaacggggagtaaataacaaggaggagtggatagtgaaaatcagatattgtaaagagagctaagagaagaaaagtggaagaacaagcagggggcagggaactggtaagaagcagatcagagctgacttaaaagagagcaatttcagcagaaaagttgagaaacaagctggattatagggttaaggaagtggttggaagtgagaaaatggaggtcactgccactgaacacttgtttgagagatttgtctttttaaagaagagtagaaatatgactgtggctggatttcttaaaattaggctgtaattcagcagctttggtaacttttctgattcatgaggtaaatttctcatctcaaatatctggtcatttgaagtaatactggagatcaaattacgcaaatatgctgcatgactaaattaaaggcctattcatgtgagcattagttagtaatgggagttgtattatatactgcattattagaaaatggggcagcatattttaatgcttaaaaatttaatcagagcaacttccagaaggaggaaaaggctcctttttaacacaagatttgaatcatggcaatttttttttttttctgaaagccattcttctaagatggtcatccctgcacatgccctcatttctgactttctgctgcacaagcaatcagtattcgtgcaaggctaatgggatatacaagaacaattagtagctctgccagcgccaatattgtacttgcctctttaaagagctcaaaatattaaataacaattggaaagaacatttcttctagactactcattagattgattttacagatgagtaaactgaatcatagagaaacaagatagtggaaatgagaagtcttactttggttctatctcacaccactgtaaggctgtgcctattatatctgtaattaagctgttgtccagataaacaataattcctgcttggctttgacttttagataccaacagatatttaaatgccggcagttgaaaaggttatttttttttctttcaaaagtgggtttgtaactattggcttaaattattttagaaaactatagctgtactttcaacataaggccacccactcaactctgagcctagactgtttgagaaataagaaggtataggaaatttggcaggtatttttctcttgtatctttaaatctcagtaagttcacaaaattttcctaaccaatattggaacaagaaattatcacggggggaggggggtgactaatctcaccttttaaggacaattaatttttctacttcacaagtttaacttcttatttggatcacaatatgctactaagatacttaaaaggtcattttttcaggccaactgcaaatgatgttttcattatagaaaagttatgtaaaagtggaaaagagatgtaagtccattaacgtgtaaaatgcaccatagcaatgggaaaaaagttttaatgaaatacgtatgagctctatcatgcgcaaatgttttgttgaaatggatgactccaagagctctgtggttccacttcagtgtctaataggcactactcactttaaccttcagcaagccctttatgaatgctatccacccaagtgtatgaaaatgccaattcatgtagggctatcagtattattgttatttcttattctgtaaaggctgcattttgaacattttaataagggtcaaagcattccaagtcaatctagatggcaattgttagaaatgcaggaggtgctttaaaaaatgagttggtaataatttcattcttctcccattttgattagtttataaatataactgtcagctagttatcatggtgaggttattggtcagtcctcctccaagtaatataaactccttaatacagtcttcagactatgaatctaccataacattgccagtgttttgatatcatcagtatcttcatcttcctttatttcaagctatgatagattttacctcttctattatctactgtaatttgctgctgacacaccaattgctagtaaatacatatgttgagcgatggtgattatgtgaagaatgaggggcaagatccctgtggtgtagtgtgtgtgcacccatgtgtgcatgaagaaacgtgtgtatgtgtgatgtgcatgcaaataatataggtctgagggaaatactgtactccccttgaaggtaagggtcatgtcttattcactgttacatccctagtacttaacactgtctctggcacagaaatgatatctaaggagtgcttgctgcatgaatgagtgaagggtactaatggtccatgttcccattggcaaaataaggcttccagtttaaaaatgagactggaggtccacctacaacaatctgttgtgctttcagtttttacaggctgatttctacgcacacagcattatgctgggacttgtgaggaaagcaaggaaactgaatacacagaacttggacttgagaagctttcagtctaattggggagacaagatacatacaagtgaaaacttaactcctaattctagagagagaatcatggcatgccaaatgtatttttttcatgtcaaatgtaaccactgcgtgagttcaggagaaaagagcctgttctgtactgcagccattaaagaaagctacctaaactaggcaagaattgagttatacctttgaggataaaagacagcagggaaggaaaggaaatgtctgtccaggaggagcgggtagagaatacagatgagcaaagttattaagataagaatagattctttgggacttaaaatttaggaagcagtcattagactttgaaaaataaatatgatggtagagacaaatataacaaggaaataaataagcatgcacattttgtatagtaatcacttcatacctaaactccttggtgaaaaaaaatgtcgaaacttagacacattctctatgttgcaaactcaggggaagtgagtgaaatgtcagaaggcatggcagcattcccagaggttagtgagtatcaggtaggctttgccaagcaggagggaggtgatgatatttgacttctgaggggataaacaggtaaggtgggatctgggcagattttcagacaaaagattctgttgtgaaggggcttctggttttaacatagatgtgactctccttaagtcttaggtgacctgatgtacttctgaaactattcattgattgtacaaatttctatttattttacatttttaagggcacagaaggatctaaactatgtgcacaactattctacaaaccaaactgaaaatcaaaatgaaatacacaaaggaaaagttgtttgaaattttgtctttaagatacagggaaaaaatcacacatcagtaaaatcaaggataaatatcagcctgaaggaggagcaataattgacaaatatttaaaaacaattgggggccaggtgtggtggctcatgcctgtaatctcagcactttgggaggccaaggcaggcggatcatttaagatcaggagttctagaccagcctggtcgacatggtgaaaccctgtctctactaaaattacaaaaattagccgggtgtggtggtgcacacctgtaatcccagctacttgggaggctgaagcaggagaatcgcttgaactggaaagatggaggctgcagggggctgagatcacaccactgcattccagcctgggtaacaaagtgagactcccactcaaaaaaaaaaaaaaccaaaaacaaaaaacaactggggtctttcttttctaaccatatctagacattggtgaaaatagtccttattaaagataataatagctatggagataaatcatccaagtgttgcatttatgtgtgagagtatgtatgtagaacagatttagcaaataatttttaaagctttcaataaatactttaagtgacttatatggacactttaaatgcacattcattaatggattcttgattgaataaaaaattaactcctgaaaatatttcctaaataaagtacatctatgcatggatgcactatgatgtttcaaccaacattaattatacccttttgatttctactgtcttgttcaaaaacactaataagacatgcactacatcatagttaataggagtgtggtgcttgttgcttaggcaacaggaggaataaatgcaggtcagaatgtgcttcaagaaaaacaaaagctagaatatgatactgagtggagactaagcaagtctaacagatttttcaccacattaaagaaatatgtttcttagagcaagccaatcatattcatgtgtttaactaagtttgcaattacataaattagattatgtagatcaataaataatttttataaaggtagaaattaatcgcttatgatactagtagcaaataaatggtgtataacagcatgtaaagcactaattgattataccacttcatgatttgcttcattttcataattaattaactcctctaaatggcaattcaaagtttttttaaaagataattctgtctcatgaagaaagtatttgattggcccatctaagttaataatattttcttattttctagaaaattataccaaatactttgaattaaacaagtaaagaatataatctatgattagaccttggttacatcatgtatatccaggattttgccttccatataaattttgaagtgcttatacatgattcattcatgaataatttttacgatctctctttgaatgcttatttgaaacctgtttgattaacctttcagttcgaggctttcaaaaaggtattatatttgctcataagtgtttaacattcagaggaaaaataagctgaattaaagtctttcagcttggccaaatgatccaggaaatccaaagacctaacttctcatgggaccagaataaatttggacaagggtttcagggttgggaatgagaaacccttatttcaagtagacatagggagaaataattaagatattgaaatgtacagtaaacataaataataaaaaaagacttcaattctgtttgatagttcttctaattcttaatgccatctgtttagtgtcctaagtctgtcctaaatctgcccagtgttctaagactttcatagcaattgaagaactttcacttttttccatttcaatacccaaatatcttgtctatataaccagtgacagtacttgataaacacaagaaaaataacagtagctgcatatatcagtataaaaaaaccaacaaatcactcataaagcattctgtgcatgcaattacttagagctcatatatcttactatatttatgtcttttttatttttaaaaactcttgggcatacatacttttggagaaggagcagaagttgaataatgttaataatcttcaaatctataatattcaagtcaacctcagagaaaaataatctaagatagaaattaaaaaatctaatcagctgtcactattgtgttatcatttctggtactagtaagctgcaggtgtcagccctattactgtatttaggcagggctattacttatttccacaagtcatttgtgtgttacatgcctgtgttatgtaggtctctctaaacttagggatcagtgatatgtgtgatgggtacttaaaagcaaggaaaggtaatagagctgtgacgtagcttaacaaggggaactgatgagcactgggggaggtatgggaatgattagaaagctgaattgtcggtttgcacagttccccatcctccttcctcacctatatgcaaaacggtggaaagttagcacatgccaggtttagattgcatgtagaccagaattcagaagtacatgactatacttactccaccaacctttctttctaaatattgacagctaaatgaccaaagtgtttattttccacctaaagtaataaacaatacttcatcgctcttcaatcagcaagtggaagtaaacgctctccataattgaccatctgaagcagtttgctaatgaactgaaggttgtccacatgatttaaactgcttattgaacaattatcaggaaaagaaatgatcttcacaccataaacacaacaaattgtctcattaaccactaaatgctgatgctcaagtgaaataatataagaatcaagaattagctgaagagtgatataatccgagtattctaagattacaaatttatttaaaaaatcataccaagaatgacagggagaatatcaatattaatcttctttcactgcctataaatagcactctcaccagttcattcatataacacatatgtatatggatacatacagatctcattttttagcaagagtctatatgtacacagcaagttcagtcctaagggcatccaattttccaatgcagttacatatataaatctgaccagttttggtgcaaatcaggctgcctctgagccatgtaagacacataagaagcaaagacagacaaaaggcagctccgtggacacagagagcttcttaccataaactgcacattgtcaaatccattagccatcaggtggttctcgtactgaggtagcccaatgctttccaaccattgtcccactgtttggacagggcatctgggtcctgtaagaggatgaagagggaagcgtttaagcagggagtagccgtccacggggtaatagcggtagtcctgggctgagaggtggcattgccacatcatgcccctgggaaagttgctatcaaaggagcccgccagcttgacagattaatgttctcagcgagagagcaaagtcagaagtaaaacatagtttgccaggcaggctgtggagtatgacttgatcctagctccacatttcttacatattaatctttactaccgaccagtacgtcatacagcccccaaaaccaggcagcagaagaaggcatatcaagctgtcagcttgggctggtctgcgttctatgtgattgttggagtactccacaatgagcaatgcacggccggcagccagaattcttttttatcaagtactcctacactcatcagtatgcagctccatgctccttgctccccctcgctcgctccccttcattacccagcccaggctacacctcgcattttcaataatagccatcagataaggcagattttttttgtctgcaagctgtaagcctgctgctgctgcttcctcctacacacccatccaagcgtcaatcttgaatgatgagagcagtcaaaacaaatgcagaaaatagcaagattcaaaagcaaaccaaagtgcttaaatctgaattgaatcttcatactggttatacgttac

SEQ ID NO: 1725 - DNA, 410827 bp, Homo sapiens; identical to SEQ ID NO: 1718

SEQ ID NO: 1726 - DNA, 420010 bp, Homo sapiens
cttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacatttttggattgtttcattctttgcttgtcatttatctgttgattagaccactaaagtgaaggattcaagctaaatacatcaacctttctatttaggctttatcagctatatgtaaattcaattctatcaaaattttctgagtgcctcctcagtgtgtctctctgatggttcctgcccggtatggctggcatgaagaagatcctgtaaaaaagagaattcatttatttattcacttagtttgttcatgcatttgtttaataaatattgagatgtaccatgtgcctggcattgtggtaggtattgggaacacaggagtgagcaaaacaaaagtcttgctctactgcagttaagggccagggagaggcagaaaaagtaaataagtaaaatctatagtgaatttggtggtatgtacaagcggaggggaaggggttacggttttagatggactggctctttcagaagctgacacttgtacagacctgaaagatgtgaggaagtgagctatgcatctgtcgggaaaccattctgaaggatacagcaggtgcagactccagtgggatggttggtgtattctgggagcagccagacggcccatgtggctggagaagggtgagtgtgaggagtctaacaggagaggcagagaggaattggggtagcaccggaggctgcctcttaggccacagtaaggacttcacttttgactctgggagccagtgtaggagttttgagcagtggtctgatttaagctttaacgaatcacccaggcagtgggaatcaactgaaaggggaaccagtgagaagcttttgtaatcatccggacaaaatgaaggtgggccagactagggtggcagcagcagagcttgtgacaagttggattctggacatattttgaagataagagttaataggatttgctgatggattggataaaggttgtgagagagacaagaaaagaatgatgcaaggttttagcctgagcaactggaagaagagagttgccgtcagctgagatgaagacaatgaaagcagctttgcggacgcggtaagtttgagatgcccgttaacgagacatccaggtggggatgctgagtaggcgggatgcaaggctctggagttcatgggaaagctccaccaggaggtagaaatctgagagtcatcagtgaattgatggtatttaaaatcagaggagtagatgaaatcagcagtgaagtgggtgtagatagaaaagacagggggccccaagactgagtccagggcagtctggagatcagtgggatgagggataagcccaggagactaaaaaggaccagcagagactaagagttgcaaattagtgtggtaagtacagtgaatgcagcaggcatgggccccttaacgtcttcttgtctgtagtccttgatcagtctgctcattcacccacctatctatcctgtactccttgagcatctgcatgccaagcactgttttaagcagcagaggaagcaataagtaaatacatttgagttgttgagagatcatggggacaacagatgataagaaaacaggacagtatcagcagttgtcttatctgaaaaatgaggatccgttcctccctccagattgttgtaggatttaatgagataaagctcctgaagcacttatctcattgcctgcactaagagaccgctcaggggacattctgcaatgccatttgagctccctcctctttgcctggcaacagccccagctgccatctctgcctccagttgtgcccttctgcatgatctttccagagcactcatctgaatcacattaaacttctctgtttaaactttgtgtttacacttctgtttaaaccctggacctgctccaagttctcttctgtagctttgtgtacactgttttctctatgctgtcctctcaccgattttcttttccccgctaactccctatgtttcacaaattctttaagatgaccctcaagagctgaagggctgccctgccctctcctagcattctcttttctctgtcatggcttttgttgttttggaattgcttgcttattgaggtccccagtaaatcgtaagctccttgaaagccaggactgtatagagtctaacatgagcctagcattgcaatgagggcctcagtaaacacttgttggatgactggaattcatctcctgagttccatgggatgaatttgcccacgtgttcataacacagtctatgttcttcctttccataaggatatcatgaggctgtcaaatgaagatgtagcatatcaccagcattttatcttgccgttttagtttggcctttttctgtgaaacatcattaggggaaagtaaaactttacttggacaaaagaggtttgctaccaaattatataaaatgaataaacatatccctggagtgtttaagtcagcaagtatggccatctattattccacagacattttatattataatttactcactgaactttaacgaaggagaaaatgattttctaataattcttagtctttgaagattgtcactggaatacattccttgctcataaccactccccttgggaccgtggatatactatacagttattaaaatgcctgaattagaaaatctgctgctcttgggctatgagtttaactatagaagaattactgtatatgctcacacgagaggggcagaagaagggggtcacatttgagacgtagcagagaccaggcctttgaagtcctctggcatcaacaatgacttgctcctgagtcaaatgatgtgagaaaaccagaatttgggaaattttcatttcaattaagattcaggaaaatgagtcactggtgttctttgtaaattcatttatgaggtcaggcccccagaactgggaatgctccttatcacatagaaatgaatagaaaaatctgcctctgtaatttccatcacccagggctagaatatgtaactagagagggtggtcgaggcctgagtttgggtctgggggttcagagcaaccgatcaaactggaaaactgagcaggtgagtggagactcctgctgttctgaggagcacacgttcgcattcattcaaatgtttatcgccgctccactcgaggcactgcccaactctcatttatcttcacagaagttgagtggatctgcagactgcagcttcagtttttagatagaggaagaactaaaccccagcagctaatcggtgacaaagccagggctagaatccaaatctgctattctttatagatagaaaggccaagactcttaggcttgtaagtcacctgtcagtcacaactggaagtagaatactcctgggttcagtggcagatgacatcagcctaggggtcataaggcttggtttcactagctggggaaagtcatccaatagcttacgtgatggttttggagatgttcttatattcaccttcaattagcagtgagcccttcactaagcccttcatcttgggcttattgccctacttgctgtcaattaacctctggagacacaccaagtcttttagaaggaaggaagggagctactattttttgagggccttttatgtgccaagcccacaggctgggcattttccatacgttatttaactgaatcataacagtgctgcaaggtgttatctctttcataggtgtgcaaacagatgcagagaggttaggtttccagggccccacagccaagtggtggagctgggtttctggtccacggccttctgtctccactgggtgacactccctgtaccttctcattgaagcccctgggctagagggtccaagagcatcacttcagttctgcatttcattcgttactcacttgcatcaggacagatgcatcactactaagctctcggagaaggcatcagatgctgtctgctcccaaggagcttctacttttggtagtctgcttaacttgtatctgtgcctgtagagattgctctttgaaaaaagcagcaggaacattctgatagaagccaatggatgggacaggtggggggaatgcgttggatttgccagcacctggccactgcccaacctgctctcaattctcagatgattcaggtattgagcaaggaaggtagcagagctactgttgccttccctttggggaagcctgtttctactttgaaactcttaagggattcatttcaaattagtggcaggccttggttagtggatctgtgtgctgtcttctgccatcttgattgcatctccccccttctccttttcctttcatttgaaaaaagatgcagcccctcagagcctcactttcctgatttgtcaaatagggaacctaatgtacaaggcttttgtggggcttagaaaaaacatgtcaagaatctgatatagatctcaataaacagcataatacttatctttcgtcccagttacaaacccccattcctgtactgcccaaatctccatgattcacaaattgcgaccctgctgcttctgctccatggcagacacctagctccaggcaccctcctctaccacctccttctccttatggccattggcttttaggagacagacattgcttacttagcaggaaagctgtcacctgctttcttttgaactatcccgaacttgattctctttgggcgacgcatacacccatcaagtggtaaagaagactgggaatgaggggagaaaagaccctgggcttgttgctggggccagtagcttgggagtgtggtggtatgtgtgtggctttggctgtcaagtggatctaagttcaaccctggctacactgactttccagctgtgtgacttcagcaaatgggttaatctcctcaaggattcacttcctagggaggctttaaatgtccccgggtgattccagtgtgcagtggaggttgagagccagcgccctctactctcacccttgatgcccaaccaactcattgccagtctcctcctttagcacagcccatgatgctgcgatgtctgccaatgcagcatgcccctttgtgcctgctctgcccataacattctcaggagcttgctggacagcacagatgtttggtgtgcatattaacccagctgtggggatctttcctgctcaggtttggtggctaatttatagagcagctctgtcaggatgatcaccaatccctcttacaggcactgctttctctgttcaagtgtctcacatgtgtgtgcttgtgtttgccttttagctattactgtgatgattcccaatgtagtagacactgccagtgaccaccgcaatatccaatctcccccttttcctcactaacaacccctgcattgttgggggctgcagtgtgctcagctaaaactaacaattgcagccacattttccatcctcctacataggggtggccaataagctgtatgcagaagttgtggggtggagcttccaggaaagctcttaaaagtctgccttattcagctggacaatgcttccatcctatggtccttaccatcttttctaatgcctggaatatgtgtgtgctggaggatgctccagcagccattttgtgacaatgaggcaatcttgaggctaaaagccacttccaaaggatggcagagtagaaatatagaaggatcttgagatttcaatgatatcataaagctacaattccagctctgtactgcctatctctgaagttcatgttacatgagggaaaattcaacccctgcctcgtttaagacattgttattgctggtctttgctactagttctttagttcaattcctaactgatacttcccaaaacaaacctggtgaataacagcaattcaacaaatgtcaccgacccctgaatctctgcctcctccacccactcaccccagctacaaacactctttctttctcctgatgagtaaccgggcatctagctgtaaggttgctgaagctttgtggaatctcagaaagtcataaagctactgaacaagttcacaaacaagtgatgcatagaccacacccagcccacagatgagttctgtgtggctcacacttattttttaaaactgggtttgctgccaacacttcaaaacccaacgattttgcgtgaaaatccagatttcttagaaaatctgtggacccagggtcttcctttctgcctggcaacaatcagctggaactcagcagtggttgcccctgagatgaggcacagccccatccccctcactcatgtcacctgtatggcttggaaggcatgtgagtttgcaacctgctcaaacccacaccccagaaacggcccgctaaaatgggatttcagaatccacttgtacctttcttctttctcagtctcccctgactcaacacagcacactggcattgtttttttcctctcagacaactcagcatgcacttttgagaatcagagagaaatccgcctctcaaatgtcagaaaacagctgatgctgcctcttacttgggggccttttgacttcccacgtgtcttactgccacttgagagggagggctgcaggcaggcaggctccctggggagcagctgttgggatgcttgattgaggccctgagacagccagaggacaattaaattgggtattgaatatgaattgctttgaatggtttttattaccacattgtgagctgactttggttgtaaaatctgactccatctcttgctcttactgtggtgatgagacagaacttcaagatgtcttaaatagcagggcttggaacatgcatattagctcatctgtactcgtgaagtctgtcatctgatacccgcgctcctccactgtctgaaccaagttaggagccctgattaaacctccgcggctgcagtcgccaccttccgccggggtgaccccattggagatgacaaatgaaggatgtcttatttcagcctgatgtgtaagtcttcacagcactggtcgttaactactcttggaaagttaaatgcccatgcagctttttttttttttttccccaaacaaacataggtctctgaggttttggagagaaaaacaaaaactgttttaataataatttgtagctatgctttttgatgagttgcacactgagtgcaatatgttggctgcagaatgaccatctttgcagaagcaactctaaggaaagtgatgccacgctaagcacagagtgagttctcaataagtagaccgacttgagcggaagacagaaacagttaagtggagttggcatttccctggttggcaccaaggtctcagggttatttcgaccacaaaattaagttccagctcctagctactaacagagtcacaatatgcagcatggtgatggtcaaaaggcctgagcaagttcaaagcgccgtctctgccggctttggaaccggtttctgtgggaagcaggactctgttgctggggcaggcagatgcttgtgtccatttgcctagaggcagtaaatgtggggctggctggctggctgttggggagctaggactggaatatggggtgggccagtgggccttgctgcatgtagactctgtgctggctgtgttggctagttagttacccaactttatttcaaaaaatgtgtttcgaaccttcagatcgactagcctatctaaaaagagaacttagaaagttattttttttaaaaaaagtcttcttcctacggatttcctgaacatggccattatattctaattctcttgaggctagatcacttatcaaattttcatttcttttcagaagtaattaggagtgatgctaccttgaatccaggtgtgaatttttattgatttttgaggatttggccacgtgttcctttatccaagcctgtcttctgctccatcttatccaaacaaacattgaaccagcaatattcccaagtattccaacttgagaaaaatcttgtgtgtcttgagaaaaatcatttccatgacttattaatgaactaactagggataattttcatagggttcgttaactcagatttatcatagaatacaatttaataagaaacaattaaatggagtaattgaattcaagtccttttttgagtaatgatgttagcattcaatgaccccccctgcccatggttattgaagttatcaatgtatcaattttccccttgaagaaaatcagctgcaaatctcttcgtcaatgcatgggccgcctctcatctgccccctgcaggcctagcccttccttttcccgtccctgctctggtctatggggctgctgtgtgtatagaaaaaaatgaaaggactgatgaccatgtagataatgtttttccaaacataccatcgaggctgtgctacaaaagtgatccagtttggtggtcctttctcttttagagatgcctgttttgacaattcctccttacagtctgctttaatatttaaaagaaggcagtgggggctttaggttaaaattaaagtttcagaggcctgtgtatctttctcagactggttgaacttggaactgtgcaacttttctcaacaattttgccaattaaaaaagtccctttagctgtagatgctgagaaggctgggcctttggttctgctcctaaatgggagtggggaaggtgctcacagaacgatgccaagcaccactgctgtacaacttctgttttatttttgtgtgctttttttataggatataaataatgacaaaaattacaaaatttataactggaagcccaagcttatttacacatatgcttctgtttcagcaaagctcctattaactttgctcctatacaattgcctcctggtaccatattttagtgttatttaactctcattttgctacatacatatcaacagtgaataggcaaaatatatacaaggaactgttcagttcaagtaatttaatattgtattaaaattcttcaacactgaactaaaaccgtatacatttgttagtttgaaataaaatgtagttattcttcaaaactcaccaactgatgaatgtaactgatcatctcagttaggtttaaaataatgtcagttaataaaaaaacattaagacaattccacaatttatcaatatcgctataatgaacttcaaaatgattcacaatatgattgttagaacaatatacattaaaatgttatttttttctataatgatattggtactgtttatataatttgattctacataaatatacattatggtatcatacaaatactccacagagacattaaaaaattaaaataccttaaagaaatgtaagtaaattttatttaatcaaatagtaagcaaactttttttttgtttgtctcaagaaaagttttattactttggaatttcttcttttttttttttgtatttattttttctagaaaaagaaatttttgcaatagaattttattaacacctttctcaaacaaggtttccatgacagaaatcttgacagcaggagcactagatttttttttttttaacatgttctttaaaacactgtgaagattaaaaaacaatcttggcaggctgatggctgcgtcagcacttccgggcctcctgctctagggagcatcaccagtattttgccaccactgagccagtcctcttggtagtagcagtagaaatttaattatttgaaatgaaaccagaaacatccctcgcaactaacctagttttcttatcaatgcattaatgaaacattcttttaataaaaatatttaatacaagacacattttgctgtgcataataaattcctctgctttgaatcattctttccttttgaaccaatcatttggttgaaaggttttctttctctgacataggtgattacatataaaatccacaaatatagaaatggggaaacagaatctcctggcaatcatatcacgggagttgtttttgtccttttgcattaaacgatactcaatgatagaatgattttacagatgctttggaggtgggaggggtagtgctgctctgatttcacctttaaaactgctgacagtgaaagcatacttttaggcagtattagagatcccctttacttttttttttttttttttttttttaaagaaaaggtattattttccccaaatgaagcaaagcaagtactggggcggagtcatcagaaataccttgggaggtggtggggaggggagtcgggagcatcagggaaaacccatctcaactcacgcctctcaggggttgcgactggaaagtcttgcgttttccatcactggtgcagaaagaacttccccaggaatggccagtggcctttcgcccgtaacaaggccgcacgctcagagcagtcttcctcctgggctgggtggacgcggaggcgcgaaggaaagcctgctccgggaccgcttggcgagcaaggcaccgcgaggacaggaggacggcgagtatcagaaaatcgtggtttcatacttggtattaatgcccctcttggcttcttggcccggctccacaatccacggtagattggccagagtcttttgctcagatgggtcgatctgctttaaaacagaaaggctgatgcctgttatacggtcgccgcgcgggtgcgcgcatgcacgcggacgccgctggcgaacccacgcgaggcccctcgccccaggcgcggggcggcgatgctggtctaggcggctcgcgggctcgctctttggacacacatttaccgcataccgactctctgcagggcaccctgagggtgacggtgaataaggcacagcccttgcccttgtgagcacacagacggggagcagacagaggcggatttcagtgctgagaggtgagatacgaggggaagagagggcaccatgtgggcacacacaccttgggagccaggggggcttcctggaggaggtgaatcaggcatgccactccccggctctcactctccagtggtttccatcacagtcagtcagaacaaaacccgaactcctcaccgtgacctccagtacccctgcccacctgatttttctgctgcagccacacagcttccttgctcttcctgcccgccaagcccacgcccagggcctctgcgctcatcatctgctctgcccgagttcccttctccagacacctgcatgcctcatgctctaatgccattcaggtctctgctcaaatgccacttccactggcacctgtattcctagaagcctttcctgtttactcctacaaaaagcaccccaacttttctgctctcctcttctgccttattcctgacaatacttattgccgctatgcgtcatcacatatttatttgttcatcctccactgccacgtatgctcatggaggcaggattttgtctgttttcatcactgccattttctccaaaacgcagaaaagctcctggcaaccccgtaaataataggcacacaataaatacttgttgaataaatggtatcaaaagaatgaggtaatatttaaatggacagccgaaggaccagcaagtatttgcctgaagacaggaggagggggcatttgaagtagatgaaacagcacatgcagcagtcccagaataatctatacaacagaatgaaacacagcctcatcttccactatatacagaaatcaactcaaaatggattaaagacttagagggaagacctgagacgatgaaagaactggaagaaaacattggggaaacactacaggacattggtctggataaagattttttgggtaaaatctcaaaagcacaggcaacgaaagcagaaagagacaaatggaattacatcaagtgaaaaagcttctgcacagcgaaggaaacaatcaacaaagcgaaaagacaacctacagaatgggagaaaatatttgcaaagtatccatctgacaagggattaacaaccagaataaataagggactcaaataactcaatagcaaaaaacaaaaataaaaaacaaaaacaaaaacaaaaccaactcaatctgattaagtaacaggcaatagaactgaacaggcatttctaaaaagacgacatacaaacggccaacaggtataggtaaaaatgctcaacatcactaatcatcagggacatgcaaatgacaatcacaatgtgatacgatctcacccccgctactattgaatggctagtatcaaaaagacaaaaactaatggatgctgatgaggctacagagaaagggaaacacttctacactgttggtaggaatctaaattaggaaaggcactatggagaatagcatggagggtcctcaaaaaactaaaaattgagctaccatatgttccagcaaccccactactgcgtatatatacaaaagaaaagaaatcagtatatcaaagagatatctgcactcccatgtttattgcagaattattcacagcagccaagacatggaatcaaactaagtgtccatcaatggacgaatgggtaaagaaaatgtggtatatatacacaacggaatactattcagccataaaaagaatgagatcctgtcatttgcagcaacatgaatgaactgaaggtcattatgttgagtgaaataagccagacacagaaagacaaatattgtatgttctcatatgtggaggctataaaaagtggatctcatggagattgagtagaatggtggttaccagaggctggaaagtgaagaagggagagtagggatgaagagagattggttaataggtacaaaaatatggttaaatagaaggagtaagttctagtatttgatagcacagtagggtgactgtagttaacaacaatttattgtatatttcaaaataactagaagaattgtaatttctcaatacaaaagaaaaatatttgaggagatggatatctcaattactgatatgatcattacatattgtatacatgtgtcaaaatatcacatagcaataaaaaacagtcccagaggtaagggaaaatggtcgttgaggggttggggtcagtttgcagggtggggagcgggaaggcagacagctaagggtgaggaggtgagcagggacccagtcaggctaagccttgagacaaatcctaaaatggtttcgtccctgtgcgtacaaatacaacgggacactcctggggcggggccgggctgtccgctctcaggaacggccctcaggtggatctacaccatggctgcctcttcctttggtgtttccaggtctgcctgccctgtcctagctgcctgctcttctcagagcctgaggttgtgggaaggcctctcccatttctctggcaccatgagctttgcagctgccttctaccgtgccttgactgtatctccataaagctgtggggaggacctcacgtgttcttagggatcactgaatatttcttaccaagaaatgcctggggctgaaggaactagaatactaatgcctgtcgagggggactgatcttgaagcacataaataacatcagtattattcactgtatattttcctatttcccttgaaggcatctggatgaatattctatgagctcttatgccacccaaccctttgtgctcttctggaagaagcctgtggggaccagggtaaggtcagatagaggcacctgctgtgaacagatttattcagcccacatgagaatgaatacaatagtctaagagataatctctaaaacattctgcaaattcctggacacttagcagcctaatcaatctcaaagatatgcttgtgaaatccatccacaggccctcattttgtcatccacagatattcactgaacacctgctatgggcctggttccggtggtgacaacacaggtggggtccctgtgtgcatgaaacttacatttttttttttgagacggagtcctgctctgtcgcccaggctggagtgcagtggctcaatctctgctcgctgcaagctccgcctcccgggtgcaagccattctcctgcctcagcctccctagtagctgggactacaggcacccaccaccacgcccagctaacttttttttttttttgtatttttagtagagacggggtttcaccgtgttagccaggagaatctcgatctcctgacctcgtgatctgcccgcttcggactcccaaagtgctgggattacaggcgtgagccaccgtgcccggcccaaaacttagatttttgtggaggaagatagacaataagccatcagtaaaaaaccctcaattaataaatgctacacagaattaaaagcagatgacatgcttgaaggtgactgggtatctatgtcagattgggtggttaggacatccgcctcttcaagtagccgagacctgaatgacaagatgaagtcagccatgcagaaaccgggggaggatattccaggtgtggggagcaggtggcataaaggcctcaggtaggagtgagcattacatagtcaaggaatgggaagagctgagcatcacagaggactgtggtgggaaactgcattctgggtacttggggcagagggtgccatgactgatctctgctgtgtggggaggggagtctcaaggagctatactgcataggcctggggcgaggtggcagtggccccgactggaagagagatggaggaagtggggaagagtggacaggattgagatatattttaggggtagggtggatgggatttgctcatgggctggatacagaggtaaggggaagacagggatccaggctgacttgtagactttgggcttgagttgcatggtgagtggctgtggggtggggaagttggtgagagaagagctttgaggggaaaatcaggaattgtgtcctggacatgctaagtttcagatgtctgtgaagcatcaaggtggaaatgtgaaagaagctggccacgtgagtctggaattggggggtgcccagggctggagatacagaactgggagccagtgtgttgggttgggtcagtgctgaatgggaggaccaggggctcagagcgtggcatcggaagaaagacttcagaggagatacagctcctggggatggctggtaatgagtgatggacacaggagcgaatggccggggctggagggaaagatcccgaaagtaaactgtcagggaactgtgagaccagatgctggaggggtcaatcctgtggatgttgatggtgccaagaagggtgacaggggtaggcccccaaaagaagactgaaaacaagaactgcatgttcacaaagggaggtgcctccctgcaaatgttaaaaatgcctgctgctgttccccatgacagtggaggtgggggctggtgagaaggaggagagacagttccagatggaaggattcgggggcgtgagagcaatgcattctgggggagtcccagggtttctaggatgcaatacggcagccggggcagaaaccagatgggaggctggttgggaatcttccagcttttgaatattgctactaccagaggaggccgctttgaagtcatgcaagcctgttgggacaggatgtctgcagagcctgtgggagggaaggggaagaaattcctggaggaaggcagatgctgagaaggaggggctgcaccttctgaacaggcaccatgccgcaggaagcctcagctgcgggagacaaagcacgcaggccatggcgcaggccttgcatatagcagggcagcctgtgcatccagcttcctctagctggggaccgaggacatcatcactgtgtacctctgcaaacctctctggaggccaggggcttgtaggaggctttgccctctgatgggatggcagctgaagccccagggaacactgctcccaagctttcctgaatctttaggtaagattcaccaagaacagcagtacctgctgctgagacccttcatagggttgctgcaggtgactgagaaagtggatttctctggaggctccaggttgagggagatggtgcccaagacttggtgggaaccaggcagaggtgatgatggacacatgccaggaggaggccaagggaaaggatgaagaagaggccctgggttctaatggcacccacaccacacaagggcctggttagcagccccttttcctcctgttcaaggttttttagaacatctgtatcgtttctacttaccacggacttgcgaatgctaacgcggggcttggggatgggtttggagggtttgttttcaaagctttctggaagtgtggaggagtgtcccccttttcttgcttgtagtgctagctggtaagcgacttcgaatgcctgtcccagggttaggatgatttcataggctaaattctgcaagaaaaatgagaaagcatttgctactggcacactgcaaattagaatgggtcgaatggctgaggaacactgagggaggtgaactagggaggaacttgaactacttcaccagaggcagcagcgattcggtggaaatctacaaagaacaggacactccgggtccaacttagggtttacaccaggctttagtcatttgtgaaaagaaaaatcttgggacctcaaatcactaagacaaacgaaaaagtcagctgggaactgtgttgggcaaacctgccttgcattctattcctaaataagatagctacaaagataaaaaagctacatacctccctcacaatttgcccaaaaggaaatttcctgtggacaaaagacagagctcaaagtcatgcctctgctcatgtgagataaatgcatatcagattgcttcccctgtcctgttgtttccctaagccagactaaggcataagtgactattcctgtaaattgtgtattcagtgaaaggctgatcttcagaaactcaaaataattcaactgtttgtctcttatctacctatggcctggaagcccccttcccatttctagttgtcctgcctttccagaccaaaccaacgtacttcttacacatactgattgatgtctcatgcctccctaaaatgtataaagccaagctgtgccctgaccaccttgggcacatggtctcaggacctcccaaggctgtgtcacgggtgcattttttttcttttttttttttagatggagtctcactcttgtcacccaggctggagtgcagtggcacaatcttggctcactgcaacctccacctcccgggttcaagcgattctcttgcctcagcctcccgagtagctgggactacaggcacgtgccaccacgcccagctgatttttgtatttttagtagagacggggtttcactatgttggccaggctggtctcatattcctgacctcatgatccacccgcctcagcctcccaaagtgctgggattgcaggagtgagccaccacgcctggtccacgggtgcatctttaagcttggcaaaataaattgactgagacttgtctcagatatttttggtttacacactgatagggcactcttgcttacagatccccagttagccccaggaggagcaggccccacagcccagtggccccaggagcccacaccattcaaagctctccctgtgggcagttggtttgtccccaaggccttggaaggtaaggggttactactggtatttctgctgagtcctgggagcacttcaaccttgcctgtgaggatgatcccacacactccacaggaggtgttcctgagaagtttgggtctttttacctcaaacatctgtgattcagtgaacatctacgaaacacaatcaaaatctaatttaggcctagaggagaggcattagtcatgctggtgtggcggctcacagtcgcagcagtgagcacgcaaacagtgctccaacagagccaattccccagctatttcttgaggcttttgctctccctgtgggtccactctatattttatcatgaaatcagcaagagacaggtgattctgtcaggctagatgccacgccaagcagcgcctgggagaaaagttcttttcttccgaccttcaatcagtccttttctcaagatgatttctagctttcttctcttctccaaatgtgtatctttgatttctgccttttcttccaagcacagcttccccttgtcttctctcactgagaaaccatcacattgtctgacccaaaagaggcagggtggccaccacaccctgaggtcacagagcatcagagaagcagatgcatactggtcacagagagtgttctgaaggtcactgtagcagctgagagcaggcatggtctgccccaagctttcttttttcttttttttttgagacagagttttgctctttttgcccaggctggagtgcaatggcacaatctcggctcactgccacctccacctcttgggttcaagtaattctcctgcctcagcctcccaagtagctgagattacaggcatgcaccaccatgcccagctaattttgtatttttagtagagatggggtttctccatgttggtcaggctgagcttgaactccccacatcaggggatccacccacctcggcctccaaagtgctgggattataggtgtaagccaccgtgcctgaccatccaagttttcattctgatgaatgtccctagaatgtccactcacggtttctcaaaaatcacagaaatgtcattctgctgatgctgatattgcaactaagctggccctctctgttcctgcccatctccaccctcatcaagcgctctgggagcccgattcccacactgctgctggggagatgtgtttgcgattgttcgcatttgaagatgatggagaggaagatgcaggatggtgccttctgaggccatgggaaagaggcccaagggttctagaccaaccagattccagatccatgccagatcaattgtgatggtctcagaaccaagtggggaaaatgcctctgagcttgagagtcggtttgagagaggatgtgtctgtctcctttaagtgagttgctaggaaatactgaccctacaagacagacatctgcctgctggagatactgcaccttgcacagcaagctgagcacttccttgcaacgaacactgagcccatgtttgcctccagagatgagtcagcctagtaaattagtaacgcaccagcaaatgatagtggaggaggtctgggagacagctctgaccatcactgcacaaagagggctgagctctttccactgcctacacttggcactcacgtcactgtcagctttgcctcttagtgtttgcgtgggtcccctctgaaaggcaggcagggcttccgacttctgtagtctcacaatgaagacacaggctcttggtcttgttcatgctactgtggaagatggctgattcccatctgttggggacatgtaccagatattcctgttctgggtgggaaactagactaagatgaaggtgtgagattcagtgattctgtaacatgtggtctttatctgctgtaacagtggaacttaatgagtgtgaattcctttaccattaacctaaaaacaagttactgaaagcgagatctacttaaagctccaggatcttcaaaggaaagtaaaaagaccttcatttgagcaagtgaggtttttcacatgattatgggaagcctaaaggttttgggagagaatgtgttagaagtcctgccctttcatttttaattagttcctggtattaggaaactgctcaaataagacacacagaccagactgttggattaagttttcctgcctaatggcttcttctggttccgcttacattttccttgacttcttgctttggttttattttagaatgctttgtcaagtttcttttgtgattatgtatagtacaggattggacactgttacctttcctctcttgtctgcagccctcctgtttgtggtactgatgctggatgccaggagggcccatgggcaccgagacacaccttccaagtgctgtgttgcccatcccgacacaccagggccctttcggggaaacagatgctcatcccatgggacctcaggacacatgtgtgaatggggaaagaacccccatttttttgtaggttcaattctcctgcctctcctattaacatccctaccatctgaaacgggaggagagttgctatcatgtacgaggagactctaccgggatgaggttgaaaattatattgtaacatcagaaggcttaggtgagaagcccatcttgcaaacctcaatgatgctggctggctctgaagagcccatggtgacacccagaaaatctgaaagcccaactgtctctgccttcaacatattatccctgcaactgtggggaggccaacgcctggtactgggtctggcacattccaggtgcagaagaaatgcttgcttgcttgctgaatgaatgaatgaatatccacaggactaactggagtaatcgtaacatttctagttaatactcagtctagctaccattaagggagaacttaataggtgtgagagatgtgccaagcattatctttgtttcatttaagtcttaccaaatcacatgcagtagcatattatcctcattttatagatgaggcagtggaggctcagaggggtgaaataactttccagacatcacagagacagaaagttacagaacttgacatgacccaatatctgtgctcaaaatcccccactcttggcccaacccatgtgtctacccagcttgtctctaagatgactgccatcaactctcccctcccgtgcacaccatggtgttcccctgttgagaagtcgaatctgctctttgaatctggactggttttactgacttgcttgacccataggatatagcagaagcaacatgctgaatttgtgaggttgaatcatgaggagtcttgcagtttcctcctgggcctctaggaacattactctgggggaattagtcatgtaaaaagtctcaccatcctggctggatgcggtgactcacgcctgtaattccagcactttgggaggctgatattgtttagctgtgtccccacccaaatctcatcttgaattctagctcccataattcccacgtgttgtgagagggacctggtgggaggtaattgaatcatgggggtgggtctttcccatgctgttcttgtgatagtgaataagtctcacaagatctgatagttttataaatgggagttcccctgtacatgctctcttgcctactgccacataagatgtgcctttgcttcttctttgtcttctgccataggcctccccagccatgtggaactgtgagtccattaaacctctttcctttataaattacccagtctcgggtatgtctttattagcagtattagaacagactaatatagaggctgaggtgggtggatcacttgaggtcaggagttcaagaccagtctggccattagtgaaaccccatccctactaaaaatacaaaaaaaaaaaaaaaaaaaattagccaggctttgtggcaggcacctgtaatcccagctacttgggaggctgaggcaggagaattgcttgaacctgggaggcagaggttgcagtgaaccgaggttgtgtgactgcactccagcctgggtgacagagcgagactccatctatctttttttttttttttttgagatggagtcttgcccttgttgcccaggctggagtacaatggcgcgatcttggctcactgcaacctgtgcctcctggcttcaagggattctcctgcctcagcctcccgagtggctgggattacaggcgcccaccaccacgcctggctacttttttgtatttttagtaaagacaagatttcaccatgttggccaggctggtcttgaactcctgtcctcaggtgatccatccgcctcggcctcccaaagtgctgggattacaggcatgagccaccgcacccagctgagactcaatcttaaaaaaaaaaggaaaaaaaaaaaagttcttgctatcctgagatcatcatgctatgagaatgcctgagctagccacaaggagaggctgcctggacaggaacaacggtttcagccaggccagcccaggctcaagatttgggagtgaaggggtctcaaagacattggagctccagcagacatcgcttggagaagactcaagacccagacagatggctccagtcgggctgccccagcatctccagccattgcaggcactctggctgaggccccagatgttgttgagcaggactgccacgcccagcccagatccctgacttacagaattgtgaacataataaatggatgttgttttatattttggggtggtttattacgcagcaagagataactggaacaccatgcgatgctgcagaaggctggttggaccctcattcagacaacaggaagatgacccatgagcccaggagctgtgatgaatgctgcttagccaggaggccaatcctggagccacccggtcccctggctgccctggctgtggggaagctcactgatcacagtgagcactaaggtgtcccatcccatctgctggctcaaaccactgtgctgcagtgaagtcagcaaaatcatgctctcatctccagttactacctcccttgggcataaattcaaactcatttagttttacttttattacctcacgtctctcgaatgctgtaacctggcctgtctccgaccttggctcttcctgtctcatataagctcattggaagatacttgctttggtctttctagcataagtcttttgagacacatttattacggcgattggtctggagtattgtctaccttacagagaccaccagtgaaagagagctgcatgtgtgtgcatgtgtgcacgtgtgtgtgtgtgtgtgtgtgcacacggggtgcaggtgtgagggttgattactgaaaacagcatactctgagccttggttttctcatcttaaaatggggataataccatacgcagtaccccctaactggattgttctgataatggctaataatattatttaaccaaatggcaataccggctagcatttattatttactatgtggccatgcaccatgctaagtgcttcaacatgggctctttaattcaatcctaaccgtatctgtatgccgtaggtctattacttccattttgcacatgagataattacgctcagaaaggttaaataacttgctcatgaagtcagcacccagacaaactgggatttgaatccagttgttctttctgagaggctatactcttcttgaccattacaccttaaaactatacataagataaaataaaaaaaattctgtaatctgttttaaaaagtttaaaaaacatgtgagccaattgagcttccaagtgactgacccatcttggctgtggtgaggtcacctactggcccattgcctgggtctcatgcccagtctggctgagaggcagcctccaggccgggggtgtacttcgtgactccacagagaccatcaacacaggaattcttcatctttggcttccccaagggtgaggtaaaagatacgaggcaactcccatcctcagtagtggctatttaggaagaagggtagggagtcccagtccaatggggaaaaacctcctggaaagcacaggaattcccctcttcccttcccttctcttctcttcttccccagggatttttcttttttcttttcttttcttttccttccttttttttttttttttttgagatagggtctcactctcttacctaggctggagtgcagtggtgtgatctcagcttactgccatctccacctcccgggttcaagtgattctcctgcctcagcctcctgagtggctgggattataggcgtgcacgcctggctaatttttttttttttttttatggcagagatggggtttcactgtgttggccaggctggtctcgagctcctggcctcaagtgatcctcctgcctgggcctcccaaagtgctagaattataggcatgaaccactgtgcccggcctgggattttgatctgcgaattaagaactgctacattagaggagcttaaggaaccactgtatcataaagataaatcctaaggcaatcaagggatgcaaactcacttttcttgtgcaagctgaagatatgcaggtcagcttatatttactgtggtttcttcaaggcaatcatggatattgaacatcaccacagatatttaccaagctccttccaagtgttaagggctgtgtccctggtgccagtcccatgcctagcctatagacaatgtccaggaagtgatcactgaatgacatgggggagtaaaagtgtccatcaagactctcattacatccagaggaggctcatggagagacaaagagatcttcctcgctgtcctcccgcatccttgtccccgaggctatacgcagcatattcatcggtctagtatgagaaaaattgcatcatagatggtgggcaatctgtcccctagaaaaagctctagccaccaaggtaattaatttattttaactggtacatcactaagatttttgtttcttagtttgaaaatctcttaggcacaagggttcactgatacatgtgcaaaaatattcattaaagtgtttaaatttttcattattagaggactgattaagtagaatactaggtagccatttaacatgaaaactggaggcgggtggattgcctgagctcaggagttcaagaccaccccgggcaacatggtgaaacgctgtctctactaaaatacaaaaaattagctgggcgtggtggtgcacatctgtaatcccagctactcggggggctgaggcaggagactcgcttgagcccaggaggtgaagattgcaatgagccgaggtcgcaccactgcattccagcctgggtgacagagtgagactccgtctaaaaataaataaataaaataaataaatcaataatgggttaaaagactacgtaaaaatatatgtatacatatacacatagataggatctgtatatatgcatagaaaatagcaatatggatcaaatgtgaatagtagttatcactgcgtattgagactggatgatttctatttttgtattttggaactttatttaaatgaggattaatgatgtttacagtcataaaataatctttccattttgataattaaaaacaagagaaagtcttttgcgtttaaaatagtcttattcttgctttttttttttgagacagggtcttgctctgttgtccaggctggagtgcagtggcacagtcatggctcacagaaagcttgacctcccaggctcacatgatcctctcacctcagcctctggagtagctgggaccacaggtaatgtgtcatcacacctggctgatttttgtatgttttttagagacagggtttcaacatgttgcccaggatggatcttattctttctgcatcaccttggggttctgagggtctcttcattctctggctgagagggctgggaactactttccagcaaaatctggaacctctctgcaggtgctgtcatggctcacctctatgtgccaggaagctgcccattcatttggcaaagaatcttgtttaggctcttcagttttcatactggatgccaattctaacatcttctcagtgagactttgaagtatcaagctcttcctttaagctgcaaccctaatacttctactccaagtgcggaattgaccctttaatggtccaacttctgccaagcccaagtgaaaaatgttgttacgtggatattaacttatagacatgcagtcaatccgctcttgtagctgtgcaaagtttgatctctgcacgaagtcaaactgcctatgaacttgaactgtattttatttcctttcataatgatgataaagcagtggcagcagcaactacacatgatattgcctactacatcctagggacgaggctaagtgccttctgtggattgtctaccccttacaacaccttacagaggaggaatgaccatcctcattttacgtgtgagaaactaaggatcagcgaaattgacaacttggccaagttcatacagcagagccaggattcaagtgcagatctgacttcagattagccagtgtttcatgccactgggctatcctaccttcattgctctcatgaatgtgctggtcttctgtgcctatttcattgaggcaccctctagaacaccatcttgtgttttggagattcactgtacaaatgttggtgaagacattattacacagtatcccctcatgggggcctaggacagaaagttccttcatacttaagtcttattaaaatactattttcggaagggaaggggtatacttttctttcaaagaaatatgcagcataaaattactgcatttccctttttgccttgacctccaggaagctcagagctaaaagctcagagctagagagagcccagctcccatacctttccacaactccatggtctgtatattgatgctacaacttttcccttgatatggagcttccttttagcctatattttccctaattcagatttgtgtgtatgtatatatatattttcagactactatacctattcatgtaggctgtcttcaatccgttatggaatgaggcatggtagaaacactgtccatttgttcacttagatatttattccaggacttactttgttgaatgcattgctgcccaaatggctgacaaggtatgtcaggcataaagcttcatctcatctggcgaatatgacgaaggagtaaggaatctgaggaggaggccatccagggaggaaaggccctcctgacccaggctgggaggctgctctttctgagtggaccattttgacctgccttgcagtgctttgcattaccattagaaacacaatggccacattttcatgactggaatggaatgaacaaatgtattcattccatagcatcagagagctgcaggcccagacaggggtcagcagaagctcacccacaccatgaagagggcacagatgcagacacgttcaagggaagggctgtgtctgtatgtgggagtccagggcagaaaagcttgggtgtcataaagtaccttgagatgtctgattgaaaagtgtctatcagtgaatagaggccataaacagagtccctggatcacctgcataggccagctccaccatgggctacctacctacagcacctattgccactgagaagtgggtgtggtccaggtgacctattggtccctttccaccctgggagtttcaggattctctgattagaaggggctatcttttacccagtcaactacagattcagtttagagatgcacgcacagttgatgctgtgctaaacagtggcatgttacccagaggccagactgcagggctccataacccaccagctagagctcagagaggcagtcaccaccaacgggctgcccttcatctcagaaaacaccttcattccagcaatcacccctaaatgctattccaaatggccaagcatttcatctattacaaaatggatttgttcttggcaatacatgcgtttgccatctcccacctttgcctggtgagttactgcttatccttgaagactcacctcgggcatcatatctccagaagccttctttgaatctcctttcctgtcctcccaaccctggctaagttaggtgcccctcctctgcggtgccacaataccttgggcacagccctacttaccacgtggtatttattatgattttctccttatagggctgattcccccagttgactgagctccttgagggctctggtctcactgggctttgcatctctagggcttagaataggtcaggtgctcaagaaatgtttgttggctaaacacaaaaaggaagttgcctggtaggtccctaagataagggaacttgcaccttaaggttaagaaaagggggaatatggatggccagagccaattccttccttctgtcttctctcccacaggcagacctgaagaacaaaagctagacaagtgcagataatgccacagggggcctgaagacacaagaaggtttttttcaatctgggttctcagtggggtctccagaaagaagcgacatttctttttaggctatattttgcttgtacttgtttttttaagacctggggtaagcctggtctacaacttgcttcacccacgtccggaggcaaaaataacttcgagaatattctgggcatattcacagacttcattgacatctctttagctctacctatagttagttctctcaagtaccagccagaaattagtcttcatagattgtacagaaataaatagtgcccaatcatagccttcagcatttagaaacaaatattagcaattctgctaagatgtctatctggggcaagatgacaaatcaactggccaaaatgcaggtagcttctttagggctaattttggctaactaaaagagccacgagattcctttatctccctaattataacaggggcagatgtagaaaattttgaaaatactaagaataaaggaaaaaataaaattcagctgtgaaattccactgttgggatatggctactgctaacatcttggtgcattttctttttatatttgtatatacacccaaatactttcatttcctatatgaatatttaaatatgaatttaaaaactagaatactttatgagtctaaaatcataacatattttatgtgcagtctcataagttccttttttgcgcaacattatctcatagttggtcttcgcatgccattacacgttcttcaaaaaccagatttttaaagggggtgagcgttccactgtatctgctgaggtttaactttatgcctcaccccaagtataggaggttgggccttactttgttaaaccacaacttgctttcttatattaatagcattccaggttccctgtggatgtcatgcactgcagcccaacacactggtcacctgtcttcatggaaccacagcctaaggtggctggccagcagccctgtcacacccatccagagggactggcctgcctgggaggaagaaacatgcaatctttatcctgtaacttggccagggtttgtgcaaaggtggtacaggaggaagaaatgccagatttcaacctctcccctgctcctcaaaagaaaaagctccagtggaagctgtagggaactcttcactaactttttgtttttttcaagacagggtctcactgtgttacccaggctggagtgcagtggcacgatctcagctcactgcaaccttcgcctcctgggttcaagcaattctccagcctcagtctcctgagtagctgggattacaggtgcctgccaccgtgcctggctaattttttgcatttttagtagagatagggtttcaccatgttggccaggctggtcacaaactcccaacctcaagtgatccgcccgcctcagcctcctaaagtgctgggattacaggcgtgagccaccgcgcctggcttcttcactaacttgtgaggcattggacatgggtcactcaccagattcaaaccttttaaatttgaacccttgttgtttaaatctttctcaaatggatatgcctgtttccttggtttagtcagcacagcaaatataaatggcttttcctttacttattgcagatgcctacctgataccctgagttcactattctaaattgaattaatgagttgccgtgcctccaaaccgaccacgtgttcactcacacagactaagtgttcagcttccaacctgcgcgtccctcctcttggagagcccaccctgctggctgctggtgcagtgcccgggtggcatggatctgattctgttgtaactatttgcttgtgtcccttcatctcctgctggaccatgagctcctggagagcagggatgtgtgtctaatgcatggcaggcactctatcaatacaggaatgcattttatgtggaatctgacttttttcctcagatgtggaagcacgcagcaacaaacatatgtcgtgaatcaaaaaccgggacataaagcctcacacagggtctgacaagaatataagcatcactattaactgcttctgctattctctgtgtcctcggcagctaagagttattgaataccatgtgctggaaatgcgtatgtgtcaccttgtttaatccttgcaatcaccataggaggtgtcctattataatctctattttacagattaggaaactgaagactagaggcattcttttttattttttgagtcagagtcttgctcagtcacccaggctggagtgcagtggcaccatcttggctcactgcaacctctgcctcctggttcaagtgattctcatgcctcagcctcccaagtagctgggattacaggtgtgtaccaccacgcctggctaatttttgtatttttagtagagatggggtttcaccatgctggtctggccagtcttgaactcctgagctcaggagatccacctgcctcagcatcccaaagtgctgagattacaggtgtaagccactgcacctggcctttatttttctgagacagagtctcatcctgtcacccaggctagagtgcagtggtgcgatctctgctcactgtactcactgtaacctccgcctcccaggttcgagtgattctcctgtctcagccttaggttcaagcagttctcctgcctcagcctcccaagtagctgggattacaggtgtgcaccaccatgccaggctaatttttgtatctttagtagagacagggttttaccatgttggccaggctagtctgggactcttgaccttaggtgatccgcctgccttggtttcccaaatgctgggattacaggcatgagccatcgtgcctggcccatggcattctcgcccaaactatgaagctaagagtgcagatctgggattcaaaaccagactgattctaaaggccaccccctgatcatgacacttgactgccagttatttagaagtggggggtgcaacaaatacatgcataaatgctgcaaagcaatctgtgaaaacaatttcagaatgtctggtttctaacttcacaaaaaatgggattaatttaaggcactgaaaactttgtctccccacccccaaaatagggatgagaagatctctgaatatccaaccacctttgtctttgtggcctggttagttctcagtgatttatgccaatggagaggagatctggataaatgaaacccagcactgttaatttatctattcttttttgggaggtggtggtgttagtgtagaaggaccattggaatgcgatgctgtcttttttattccatcagggccatttgctcctcttaggagctgcgtccttcctgcagctgacttgctggtgagtttcagctggctggacagggccagggaacggcttctcttttacctgtaggttgccactttgtatgcagaagagtaaccagggaaagtgttcgagttcaatttttaagggctctatgcattgtgacattttcttatattgccatttcttttcacagtatcacagtcaaataggttgaagtctattttcaggtggagaaaatgagaaacagaatgagagagatcacccgcctccatgatattaattcaattgtcagaggtgaactaacatcaataatagcaagagttcttttgcatctttaagttctcactttgtgggacaatctctgcaacataagccataaatatttttcttcagggacctcaaactactccatggaagtaatctcggcatttaaaaaagcactcaagaatttaaatttttctttcctttttttttgagacagagtcttgttctgttgcctaggctggagtgcagtggtgcaatcacagctcagtgtctcctaggcccaagagatcctcccacctcagcctcccgagtagctggcactacatgtgtgtgccaccatgcctggctattatttattaatttttttttttttttttgcagacatggggttgccctatgttgcccaggctggtcttgaactcctggagtcaagtgatcctcctgcctcagcctcccaaagtgctggggattacaggcatgagctactgtgcccagccaggaatttaaattttattaaactgatgagaaaaccaacaagcaaactcatagcagagccaaagttggaagtggtgtaggtatcactgatcacgaccacgtggttgatgctagtgtttttcttgccccacactttggctggctttgtgcatatggatgggagagtactacagaaggtgatcacacagtcggatgaccatgttttcctgcgttttgtcacttctgtttctccagcttagatcctcacatggcccacattcagccaagaaagcacagggaagagggagctccgtctcccacacgtcccacccaccctgcaccacgtcttcaacattctctacgcactcctgagaccgtctcagcctcgccatgtgctgcacaccgaggagcacaggatttgggagttgcaagtgaaaaatgagcatggttaaaaatatcaaagactgcaaacatattcttttcagaggagtgagaattagcaagggtctggcagcaaagccatggcttttaatgctattaaaaaggaagaacaccttttaacatttaaaactattgaatgaggctcttctcagatatttgatacaaatctgatactcccatggagaatgcatcaaaatctttctatgttgacttacatcaactctctattactgagaaatctagagtaactaagcaaataaaatacagaagacaacagttttgaaattaccttggttgtctctctctctcacctatagtggccttttgaggacgatcacttcagcctcgggatctggtggccactgaaatacccattccctctctggcagtcccatttgtgtagaattctctccactcatttaagagcagaggagagaaaagctgagtccatttttaactctcacaactcctagtctcataacacatccttcttttctgctcaccctacagttccctcttccccaagttctcactgcccagaaggtggagtttggggaagcttttgttctacagtgggtgagatgtgtttcaggcctagcaagttagggatatgattagaaatcagctatgacaacaacgagagcatagactccagaatacagagcaggcttggtgcttgcttgtgtgtatatattggcttttttcttgacaaccctaattctgttttgctctagtctttttattttcatctccccatcatttaaaactgaaaatatcacaagctgaatttatggtagattccaagcaacaaaagcaggcttagagatcatcaaatgtaacattttccaaaatgtgttctgcagaaggccacccctgtggggtgctctctaaaaaaaaaaaaaaaaaaaaaaaaaaggccgggcacggtggctcatgcctgtaatcccagcactttgggaggccgaggcgggcggatcacaaggtcgggagatcgggaccatcttggctaacatggtgaaacccggtctctactaaaaatacaaaaaattagccgggcgtgctggcgggtgcctgtagtcccagctgctcaggaggctgaggcaggagaatggcgtgaacccgggaggcggagcttgcagtgagcagagatcgtgccactgcactccagcttgggcgacagagcgagactccatctcaaaaaaaaaaaaaaaaaaatggctaccatggccaaataagcttaagaagccccgcacactccacccccgcctcacatctgagcacattcagggccctgcagagtcccatagtacgtaaactatgttaagctcacatcctagcttctgtagggggggctccaggcctcctttctcggactacaatttctatgagaaaatgctctgaacttcaaatctaactgtccataaactggaaacttcctagacatcactgaattttcttgatgatatcagataaaaacatgggatatgtgataacagtacataaaaacatgtgacccataaaaggtctttaaggtccaaaaagcagtaacttcacaattaaaaatgtatacatacttatttagctaaaaggttaaatgtgtatttgaggtattatagggtcttctttactttttttttttttttttttttttttttttgccatttggggcagcccaggggactgattcatatcaaaagaattttaagccttcaagactggactggtattgaactgccctacataaggatacaaaatccatgctcaaagaagctttttttagtgcaagtgaagcttgttgcatctcagaattgctcaaagtcccaggtcaagggtggtggcctttgttactaattttgaggtttgacaaactgttcacctggagaagattaaaatggaggatctgtgtaagatgaaagtcctttggagctggtatgagaatcctaagctagtaatgtttacattaaatcaaacatctggatgaaaagataaatgttaaggcaattctctacatgtttttctaagtgtatcagggatataacgttcatcataaaactaaacagttgactatttcttcccccaacatttcacctcagtattctggtgatatatatatatcacacacacgtatagctaataaactcaagggggcagatagtccacagaaaccagttttagtttcatgtggaaaaatactttagatactctgatgaaggcaaattatatattaccttaaaaaccaattttattgaaagaaatgctgcaatacttaggaaaaaggtggcgttcatcctgaaaagtatcagaatattcatgttgatgttcaatgcaaacacggtctagaggcagcaagctctgtggagtcaatgttttctttctgctatttctattttaatgtttatttattgctttcactttttcaatcctttcgtaatggcagtaggaaaactttggaagataaatacacatctgacaaacctatcttatgtcttttagcagaaaaagggtcaggctgttaactgacgtcagcaggcagggagagggaggaggtgaaggaacaaatgctgaacacctgttatttatgaagcactctacatatgttctttcatttcactcctggtgaaaacctgcaaggtagaaactcttgtctctgttctctagctatgaaaattaggactgggaaaagtccagcaacttctctaagaccagagagtagagagatagctgatttgggatgtgaactttggtattccgttctttctatgacatcaatccaacccctatagagaaaggtatttcacataaaccaaaatagatgtgaacaggatgaaatttgactgtataaagaaacaatcaaattttacaagaattgcaagttatgtttaaggcaccagaaacctaacactgcacatccttgtaaaccctgaatgaaatggctttaatcaacactttaatcccgtgcaaacaaacgcttcctgagatatttagagcagtctcgcagggctttgctttgcagtctttactgttaccacagactacttttatatcactctcctcaagcctccccaaatggaagggtttgtttttttttttaaaggcccatgatcattctttcccattttcaatctttctttaaaaaccaaaaggggtgaggaacatgtagcatgatacaaatgctctgagcatgaactgcctgactcacggaccttaagctggtatagattttggattacagttggccttggcctataggtgttcatcagaactggaaaacattgcttcaggcagtcttctacccatgacattgaactgggggctggcctctcacgaatatatgaatacgtgattcctgattctttaaatatgtatatttcaaacccagtgagcagagcagaatcatcaaacttaagtggcattttcaaattcttctgattataaattattaatatactatatcagagatatcctcaagcaatttgtaccaccttgagggcatatcaatcttaaagaaacatttgttatttcctttaattgtttccattttccaagtttgtaatatatgagctagtcttttaggtttaatgacaagtatggctataaatggaagtggtgtaatcccataaggatgtcattacaagaccaactttttttttgagtgacggtttcactctgtagtccaggctggaatgcagtggcacgatcatagctcagtgaagcctcagtgtcctgggctcaagggattctctcatcagcctcctgagcaactgggactacaggtgtacaccaccatgtctggctaatttttttttttttttttaatagggacaaagtctcactatgttgcacaggctggtcttgaactcctgaactcaagtggtcctctcaacttggcatcccaaagtactgggattataggtatgagctgtgcctggccaagagtaactttttttaaaaattgagacagggtctcactctgtcacctgggctagatggcagtggtgtgatcacagcttactgcagcctcgacctcccaggctcaggtaatcctcccacctcaccctctcaggtagctgggactacaggcatgtgctatcacacccagctaatttttgtttgtttgtttttgtagagatggggtttcatcatgtttctcaggctcatcttcaactcctgagctcaagtgatctgcccacctcggcctccaaaagtgctgggatttcaggtgtgagccactgagcccagccaagactaatttctgaatgagcatatgggccaaatcttggagttcccaattaccacctgtaggtatctgatctgactcctattcaatatagaagactgcagatttgtatgaggcaaacacacctattatgccctagtacttagaaatggctactagagaaactgacagacatagtgagggacaaggaggctgtaagacctttactatgttttggtgccagagaaacaaagggatttctcaagtctgaaagtgaaattagtaaatgagtaatggcagttgagatactaggtagggctggcattctaagttgaatggaagaatgaaaatatcgaaaaatctccaaacagcctagtctgccaaaatgtacttggtgttatgagtggaactgtgacccacccaaaattcatatgttgaaggcttaacatgcagtaccttaaaatgtggctgtatttgaagatagtgccctgaaagtggtgattcagttaaaatgaggtcattggggtgggccctgatgcaatctgactggtgtccttacaagaagaggaaatttggacccagacatctaagcacagaggaaaggcgatgtgaggacacagcaagtacgcagctgtattagtcagttctcacgctgctaataaagacgtacccaagactaggtaatttataaaggaaaggggtttaattggctcacagttccacatggctggggaggcctcacaatcatagcaaaaggtgaatgaagagcaaagccatgtcttacatggcggcaggcaagagagagcttgtgcaggggaactcccatttataaaaccatcagatcttgcgacacttactcactatcatgagaatagcacaggaaagacccacccccacgattcaattacctcccactgggttcctcccatgacacatgggaattatgggagctacaattcaaggtgagatttgggtagggacacagccaaaccatatcagccgccatctacaaggcagggagagaggcctcagaagaaaccaaacctgccgacacattggtcttacacttctggcccccagaagctgtgagaaaatgaatttctgccatttaagcctctcggtctgtggtactttgttatggcagccctagcaaacaaatacacttggtatgtatcttaataccgggtaaacaagccaagctagtgtgttaattataagttgggctttcaatacagtccaggcccattctgcaaagtctttaatctgttgaaagggggtgggtactcaccacatcaaaggcagtaaacacatgacagtagtggtgattagacttcaaatcttttgtgatataggcaaatgttgagaggtcttctgggtcctgggcagcacaggagatattacgaatttcatgctcagcaattatgttctggaagaaatgacataaatgatcattgttttcctctgcgaaccagcatatatgacaaccaagacaagtaacccaggaagcagttgctttccttctttctggagtgttctagactagcaacactcaaagtggtccactatattatttgtgggtaaatgaataccagatatggaagaaatattttcatttaattaaaaacaacctaacacagtcatatcctggagctgcagttctcaccagttgctgtgcatagaagcagtctgggtggcggccactttttttttgtttgtttgagacaagagtctcactctgttgctcaggctgaagtgcagtggtgcaatctcggctcactgcagcctcccgctcccaggttcaagcaattctcctgcctcagcctcccgaatagctgggactacaggtgcatgccaccaggcctggctaatttttgtatttttagtagagacggggtttacaccatgttggccaggctggtcttgaactcctgacctcaggtgatctgcccacctcggcctcccaaagtgctgggattacaggcgtgagtcaccgcgtccggcctccactttaaaaaataatagtaattactaagcatttgactgtttccattccccatgtccacctgtagctgtgcagcactgctttctgctaattctgtatggaggggagcatctgtcgctttctctgtatgagaagagatctgacccaatgaggctcttcaaatccctcgccatcatgcttgcacgttgttcttgtgtcctgctcctcctccctcagagcaagggcaggtactgaaggaagcaggcaggtggaagcctcaaggtgctttctccgtggaaactaaggtgcaggggcctgataagagaaacaccatactgcaagattcaggccttggatgccttgcttgatctgggccctgtggctatattaacaacactttcctaactacatccactgtgtataattaggaggtggtgctgttgctaccattatttacaggtgaagcaactggtactcaaagaatttaagtgccttatgcagagcaggtgctggggtggaactgaaatttggggttgtctgactgtggagctcaggctctttgaaatgcattgcaatgcccttcaacgtctccacctccctcttactggcttaacaagaattgagttatttcttctctagcatctctttgtgccttcttccctggtgggagaaaggtttaagtaccattgtcctgaagcacaaaataaccacgaagcagcttggctgcaaaccctgctagaaacttcttttgatacatagatgtgtttaaaaagaaaaaaagaaaaaaattcacataatcttgcaatcattttcttatcttataatatcccatttatgtttttttgcagttgtcacagatctaaaaccctcgatgctttagttactctaattactttttaattgcgctgtcttaaataacctgttggcaatacagtgttccgtgtacagccatcaatgcctaaaaatgcttacaaaatgtccttccctgccagcacccccagcaagtacttcatgtccctcactttaccaagctgagtggttcggaggcaattacagaattaactcacaaaagaaaattaaattaagacatttttcaccgtggccttttgtgttgacattaatgcagtgctctgtcaaaaaataactcaaattgcaattggaatcccataaacaagtaacattctattgcaagataagtttcagactagaaggtgatgatcctcttctggcatccagatagcattccttcaagtagaaaaccaaattagggatgggtgagtcttaaaataatgttaaaatgagaaaaaggtgcaatgtgagatggtgtgggaacctctgccattatcttgattgggggcagccaatgccctgggaagcctgggtggatttggtctcacttgtccaggaggcactgtcacaggaaataggtgcttcaacttttactaagttggcattttgtgttcttgagatcttttgcaagatctcaaggtagatgcacttcttgggaaatgaaaagtgctctgtgatttttattgcactgaactctctgaatcttgccaactcatgggatgccactcttgacaatttccaatggtgcacggcagcactgtggcctgggggaaagttgcaaaggaggaaaagtatatctttggtactctctcctcctgtgtctttgctgacccctgaattttctggagccctcttcttctctttctctctctctctcttttttttgagatagggtcttgctctgttgcccaggctggagtgcagtggcaccatctcagctcactgcaacttctcaggctcaagcaatcctcccacctcagcctcctgagtagctgggactacaggcatgcaccaccagcctggcttattttctgtattttttttttttggtagagaaggggctttgccatgtttcccaggttggtctccaactcttgggctcaagcaatccacttgcttcagcctcccagagtgctgggattacaggtgtgagccactgtgcctggcccagccctcctgttctctattccccaggagcccaggactgtcttttagctgcccagggaggcctgacctctgtgatactccatgttccaaaatcagccttctccccgactgtggaaacttctactactctgttcccattgtctaagctataaggaaagctcatgctagttaaaatattctatattcaggtaggaataactcatcattgtggtcatcctaactggcgcttaaaagatgctcttgaatttgtattgatagcctgcggaggcaggtatttttgaacagacctttgtgatatattgccaatgctagaatggggtaaggtcctgggatgtcactactgaaatactgccatcactctgcattgtctacctgtgcagaatggtgaagccagttctctatgtgcaggacgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtactgcatcctacattaattcagaaagaatctagtttatcaaaacacactgttctccacttgacaagtgatttccaaaaatccttagttagcatttagctacagctcttggtcttgagagcaattaacaagaattatttaattcttcatggtttctcagggactgtgaatggataaaacattcttcacataaaacaaagagttcagttcataatgacagattcaagagttgtacccagaatagatgttggccgggtgtagtggctcatgcctataatctcagcactctgagaggccgagacgggcagatcactgaagatcaggagttcaagattagcctggccaacatggtgaaaccccgtctctactaaaaatttaaaaattagctggacgtggtgacgggcgcctgtaatcccagctactcgggaggctgaggcaggagaattgcttgaacctggaaggcagtgattgtagtgagccaagattgcaccaccacactccagcctgggcgacagagagactcaaaacaaaaacaaaaacaaaaaacctgaaaaaacaacgatagagttaataagatcaggggtcttgctgaagatgaagatgtatagtttttttttttttattaaagttcccctattctccctcaaattaagcacatgctcttgagagatgtgacaggcaaacatgaacatgggcttgtgtactgcccctgggagtgtaatctggaagaagttttctagaaggcaatttgggaatagttatccaaagtttcacagtgtgtataccctttgatccagccattctatatctagtggctcattctaaggaaataatcaaaccaactgcaaaagatttaggtaaagggtgttacccatagtactggctatcatttgaaaagaattggaaatgacagaatgaccaacaaggagaactggttaaataaatttggttcaactatggattggaatattgtaaccaaccaccacaaatgatattggggatgaatatgtataggaataaaaatatttcaaaatatattattgtgtttaaaatacacggtaaaacagtggatatgcaatatttccacttcttactagaaaaatagtacctacaaatgcataaataattggtctggaggattacacaagcataagatgttaacagggaggaatttaccacttctaggtggtaaaatcacagttgtttttatttctccttcctgtttttctattttagaagtgaacagtaatgaacgtgtattgcttttgtaataaaattttaaaaatgtatgattttaattaaaaatgccaattgcaaatgtgtgaaaaaacacactgtttgaatctatcacttataagtgcaacttctgtgttttttgggggtgtgtgtagccatcttgagcttatgaagggacccactgaggagctccttcctctgagaagaaaggggtagttgtcagcaaatgagagtacagggtatgtttggattcctggcttagttccattccttccttgcggcgtggttaggtactcaacctccctgtgtcttagttacttcatctgtaaacgggtatgttaatatagcatctacattttagagttgtgaggattgtacaggataattcagtgcctagcatgtagtgaacatcaacagattttagctattactgcttaaaaacagtattttttttggtagagatgggggtcttattgtgttgaacaagctggtctcaaactcctggccccaagagatcctcttgcctcagtctcctaaagtgctgggattacaggtgtgagccaccttgctcggccagctgttattgttattctgaggatagatgctttcacttagaaagtccctctccaaagcaaagcactggcaaaagagagcagaaacaaaattgaaatctgtgtgcataactgaacactctccaggctacttgctatgatggcagggaaatggtggttgcaacaatgaactttcagtggatcaatatacctgggccaatgagaagagactcaatcaatcaacatgtttagaaagagcttgagacaagtgggaattaaagacagaagcagcccaggaaatctttcagtgatgtgaagtagtaagggtgttatatgggagaaaagctagcaacaagggctataaaaaataacaaagagaactggggtttgaagacaatatggaataagatggttggtgctctttagccttctagagtaggcccgtaagaaaacattcacaatgagaggctgggcgtggtggctcacgcctgtaatcccagcactttgggaggccgaggtgggcagatcacaaggtcaggagttcgagaccagcctggtcaatatggtgaaaccctgtctctactaaaaatacaaaaattagccggacgtggtggcggatgcctgtagtcccagctactcaggaggctgaggcaggagaattgcttgaacccaggaggcagaggttgcagtgagccaagattgggccactgcactccagcctgggagacagtcaaaaaaaaaaaaaaagaaaacattcacaatgggaaaggcacatgtgagcaaggatcagcaataaggagttacctatgtggctgtttctttgtgggcattgcgattcaatagacacacaacacacatttatgggcttagaagctgtattcactatgactcacgcagtatttgggagagagtgaaagaaaataattgatgcttccatgaaattgggcaacagagaatttttttttaaagatgggatctggctatgttgccccggctagaatgcagtggctgttcacaggtgtgatcacagtacactacagtctcaaattcctgggttgaagtgatcctcctgactcagcttcccaagtagctgggagtacaagtgcatgttactgtgcccagctcaacagagacttttaaaaaaatagttgtttaaaagttttttttcccagtctgattcctaagaagtaattcttgaagttatatctgaaaatgacaacttgtcacagaaggaatttgtatgaggacagaggaacaaaacatgattttagtttgagtctcttctaagaggaaagaggcttttacatttagtatttccatctaattttaagatctaactttttcaaagttttccaacccattccctctattgtttcctaaaacacataaaaaagagaaaagtcttaatacttcaactagggcatggattattatttggaaatttgtatatttgaaaattcacgctttagaagtgcttctggattgaaagtttaaaaatcatacaaattaagaggaacagattcaatgagaactatggggaaactatccaaatcctttgggaaataaaagttccaagacctaaatacactagatttgcttatttctgacttaaaaataatcttaaaatatttcctttcttatatcaggaaggcagatttctacctcatcttagttgaaaacagatatttcttttttggggaggattattttttaaaaatatcaattgacacataataactgtacatattcatggggcacaatgtgatgtttcaatatatgtatacattgtgtaatgacaaataggggtaattatcatacctggaaccttaaacagttatgatttctttgttttcagaaattcaaaatcctcttctagctattttcaagtatacagtacagcattgttagctacagtcaccctactgtgcaattgggcaccagaacttatttttcctacctaattgtaagtttgttaccattgagcaacgtctccctattcccctcctcctcatctaccctttcctggctttgataaccactgttctattctctacttgtatgagatcaactttttagattccatgtatgagtgaaatcatgtggtatttgtctttctgtgtctggcctatttcacttaacataatgtcttccaggctcatctatgttgtcacaaataacagaatttcattctttttctttccctgaatagtattttattgtgtacatataccacattttctttacgcattcatctgttgatggacacaattttaaataaacacttagcttggatccacatcttggccattgtgaatagtgctagagtaaacatggaggtgcagatatcaacatactgatttcatttcctttggatatatacccaatagtgggattgctggataatatagtaattctctttctaattttttgagaagccgccatactgtttccatcattgctctactaatttatattcccaccaacaatgtacaagggttctcttttctccacattctcaccaacatttgttatcttttgtctttttgataatagccattctaaatggagtaagatgtggtttttgctttgcatttccctagtgattcactttgggtttgctttgcatttccctactgattaatgatattgagcattttttcatatactttttggccatttgtaagtcttcttttgataaatgtctattctggtcatttgcccattttaaagttgattatttgtcaactcaaaatggattaaagacttaaatataagacctgaaaccactagaagaaaacgctggagaaacacgtcatgacattggactgggaaagaattttttggatatgactccaaaagcacaggcaacaaaagcaaaaatagacacatgggattacatcaaactaaaagccttctgcacagcaaaggaaacaacagcaaaggagacatcttagagaatgggagaaaatatttgcaagctatacatctgacaaggattaatatccagaatttataagggacccaaacattgcaatagcaaaacaacaaataatcctatttttattactttttaagagaaatttccttgagaacaaacacctgtgaatgatactaaccatcaactatgggattagagaacgtaagactgcagagagtattaaattgaatataatggcttacctcttacagtaacagatgcttcctaattgtatatttaattagggaagtgatgcattactgtatattagtgaaaattaagccccagggcaaaattcagggttcgggatggggtatgggtaagcctagggaggcaaaattgaagagcagaacctcatctggccagagcaaatccttcacttcaccaaaaactgtatgtcttggaatctttgaagtgggagttattcataccaacataacaacaacaacaaacccactgaaaagtcaaagcaatatacttatggctttgtaaaatccagtcctgtggacacattatttaaaagtggtaattcttggccaggcgcggtggctcacgcctgtaatcccagcactttgggaggccaaggcgggtggattacttgaggccaggagttcgagaccagcctggccaacatggtgaaaccccgtctctactaaaaatacaaaagttagccaggcatggtggcaggcgcctgtaaccccagctactggggaggctgaggcaggagaatcacttgaacccaggaggtggaggttgcagtgagccaagattgcaccattgcactccagcctgggtgacaagagcgaaactctgtctcaaaaaaaaaaaaaaaaaaaaaaaaaaaaaaagacttcctctcaagcttggcaagcttggcgtttggtcgatggggacccatgggggttcaacatgtgtatcaagaagtgttatttctgtctggggcccatccaccctggccatggcaagatgttcatccgcaatgattgcaaggtgttcagattttgtaaatctaaatgtcattaaaaactttaaaaagaagtgcgatcctcacaaagttaggtggaccaaagcattctggaaagcagctggtaaagagcttacagtggataattcatttgaatttgaaaaccgtagaaatgaacctatcaaataccagtgagagctatggaataaaactactgatgcaatgaagagaattgaagagatcaaacagaaacacgaagcttaatgaacagattgaagaaaaataaagagctacagaaagttcaggatatcaaagaagtcaagcaaaacatccatcttatccgagcccctcttgcaggcaaagggaagcagttggaagagaaaatggcacagcagctacaagaggatgtggacatggaagatgcttcttaaaaatctctgtaaccatttcttttatgaacatttgaaaatgccctttggagacttgaaactgctaaattattagcttattttttacataaggccacttaaatgaaaaatgattaaaatatatttttcctaccttgccatctaatggcactaggcagcatttgtataataactaatggcaaaaattcatggctagtgatgtataaaataaaatattctttgcagtaaaatattccctttattaatgttatagaagggaggatacaacaaggaactaacaatttgtatgacagtgtcaaatattatttagattttagaatttcctgttttgcttcatttgcatcttagaagagcataatgacattgtttgatgaagcctaattatgctggactgttttgagctggtttaacccttctgataggtagttgtggatgtcgaggatgagaactgaataatctttgcctgaaatcacactacactctagaatttccactctggagaatactcagttctaacttgtgattcctggtagaacaaactttatttttctagcctagcaatgatctagaagcagaggaatcccagtgccttttaaaagttattatgtggttttcttttaaaaagctcctgtttttggaaagtagaatttctgggtacaacatctgtttattatttgcacataaaataagccatttaaaaagtgaaaaaaacaaaacaaaacaaaacaaaaaacaaaacccagggcaatgaatgttcctggcacattggagaggcagtccagtctctggattcacagtgtgggtagtggagtggactgcctggtttcaaatcctggctctgccacctgctgtctgtgtgaccttgggcaagtgacttaacttctcttggactttgttttcccatatgtaaagtgggagcaatggcaatacctactgtgtggactgagtgaactaatgcacataattcagttgtgcagggcagggtgtacagctctcaactgctacctgttattagccctaataaactgattttaggagggcatgagtatatgtcatttttaagatcgtctattatgatcccttaggctgatggcaacttgaaagtgcctctatggtaatacttctaccactttggggtaattaaatgttcacatgttggtttcctccactggattgtgaactcggtggattttagtcatctttgttaacaaagtacatttaaggaaacattgatcagaattgggaaccacagtgatttacttattactgggagagacattttcattttggctaaaatgcatactttgaacagaaaacatctttttttcaattaaaagaataaacaggtaactcttaatctacaatactttggcctaataatattaccatgaatcaactttttagaccgtctgtgtcctaaagtatttttcatggggagttttgattgaactgggacttttggctgaaatgccaccatgctgagaacagagaaaacagcaacttggggttcaaactgaaaattagctgcaagttgagatctacatcatttatagttggtgaaagttctaattcacaatagaatagttccagatagcagatcaaccctatgcttctggttttgaaagactctggtgaaatgtagtgaatgcaaccttagctactttatcaagaactgagacttacttaatcaagattggaaataagggtttatgatagtccgagaagtaatgaagtttctattttcatgtaaactacataagcaccaagagcagcaaaccagaaaaatgccccccaaaacagaagaatggcttctaaatatatgtttttttctaagtttcattttaagcaacagacaaggatttaactaaattattctctacttaggctactaaaatggcttttctattgctatcaggatgtaatttcagatccactcaatttcatgaaattgactgagattcaaatcatacatctggtatattttaaatgatgctgcatgcactaggcaatactgatgctgattatcacaccggagtagctggtctcaggtaatttagttaagagtattaaatcagagatgcccaattaatttattagacatgttcatgaatatttctaaaattattatgaggcttgatgaatgaaaactttccctttttcttattgttcattggtgacacaaattaggccagataaatatttagaatacaagatttccagaattataaaaccagggagaactctaaagtgtatctagtctaatgttctcattttatatgtaagaaaacagaggatcggggaaacaggagaatgtagtggttaaaagcctgggctctggagtcagacagacccgaattccagtctcagattggcaagttattccctgtgtgaccttgagcaagttattcaacctctgtaagcctccatttcttcgtctgtaaaatggggacaataattgtactaggggacactgtaaagactcagtaaatgttagcagctatcatattatttttatgaataacaggtgactcctaaggcaaataaccagccacggaactaaaacttagagtttctgatatatacagaagcttgtttttttatctaaactcagtacctaagttaaatattcactggtactgacaatttaagtactgtctaactctgcattaaatagaaggataactatttcagtcttttttgctgttgaattgatcaaaatattagtgattacatattgaagtctcaatttcatgaagattcacacatatttagctttccataaacaatggatatttcatgtttaccttcatagctgtttcagtgtaattatatgctcttaaattattttccaccaaaagctgctcatataaaataaacaacaaggtatattggccataaataaaagttaggattgcacttactaatgaccttaaatttgactttagttagatgctatattgaacaagtctgatattctcaatttgtgcagttactcagataccagcatagcctctatacacctgttatggaggaagcaagaacaagggacacgtacaaaaggaaaaggtgggtctgcaatacgagttagagttgctttggctaaaatagactcctaggaatcaagcagccactaatcacagatatttggaattgccattttttttttttttttgagacagagttccacttgtgtcacccaggctggagtacaatggtgagatctcagctcactgcaagctctgccttcaggttcaagcgattctcctgcctcagcctcccaagtagctgggattacaggtgcatgccaccatgcctggctaatttttgtatttttagtaagaggggttttgccatgttggccaggctggtcttgaactccttgacctcaggtgatccacccaccttgacctcccaaagtgctgggattacagacgtgagccactgtgcccggcctggaattgccatttttagttaacatttgcccttaaatagttcattccactcaaagttgaatttaaaaaaataaaaaaaaaaaactgagtaagaaattgcataaagaatattagctttatataatatgctcttaatacttctgcttttgataattttagtcaattggtgatgttttcagtaaatattctcagactattcagtgcgtgcttaaaaccttttgttgtaataaagatcatttttctaatctcgaaaatgatacaattaattttaaatctttaaaaataattaagaacaaatatagtacaaatatagcaaatagacattaactcaaactatagtgagataagttcaagcataaacatgcagaaagcaagagcacctttttatgtaataccaatgtgattcagcagaccaacagatggagaaaatagtaatttgaaaggtggcaatttgtatccatacccagtatttagtatttcagctactagaaataaagtagtttggcagacttacccgcatttttgcacaagcatcttgggttgattctgtccccctaagctcttttatcagcatagaacctaaatactaaaatacaaaaaaaattcaatgatttatgaaatggaatatacatatgagtaatgttttaaaaacaaattgtggaagtattactggctaggtttcctggctgtaagttgttgcataactttaaaaaactgacagtaactaatcctaacaaataaatgcattcatagagaaaatgcagcagaattaaccataagttctgggggctgtaattgctctttataatgaaactgcaacatcttctaaagatgccatctttcaaatcatatttaactgcaaaatgggggcatctaaaaatgttttccccttttttgaggcagcaatgtctgcaaaaataaatcacactactatctctgtaattacagggttgcatgagacagctgagaagctaagcaacatgtcccccatttaggcttattctgctgcataggtaattaatgttaggcttttaggcagagatgcagttttggacctttttcattcacagctgtgtgccctatggttgatccacctgagaacgggatgggagggtggggggagggagagaggcattctcagttgtttcccaggggaagagagctgggttcctggtgcgaagtgccacctggagggctgaatggagctagaaggatgacagtctcccaagaattgccaactactttgttgttagaagaccagaccccatactgtatcatcctggtacaaaatgcccctcgtgctccagcttctggctggggccaaatggttttaaacaaaatgtctgatttgcctttctatcaattgactccccttcaaccttttgaagctttagtagggtttttgccttttgtcattcccctgccccttgccctccccccaccagcccccaaagagctctatatatgttttttaaaaaagtgaattacaataattattttagaagatatctgatggacacttcctgacaagactggagacttgtactctgcagagacggggatgggaaccactcttgtggactagggaagtgcctgacttgaagaagacgtgagagggcacaacagcagaaggcgtggtcagggccttggagaaaggcatgttcagaaaggcttggggacttggggtttggagggaggagccatttcaatcctatggttttgggcagtaccactgaaataaatccaaagctgcaatataagtaagctttagtaaaagaggggcagaaagcagaaaatgaaaaaaaaaaaaaaaaaaagctcaactggtatgagataaccacaatgtccatctaaatcaaatgaaggtgaaatttattatcttttggtaaaatccttatcttttaagttatcagggaagtttgcctgattgaaatgtttctttttaagagaggcagtttcaatgcactgctgaaggttcagccactttttctgctgtcgtcaagacaaccaccacctgacccaaaacctacagtatcttttgaacatttaccagttcctattacatttctcagctaattataattaattcccctcttctaaaaaactaaacaactaacctaaactaaaccaaactaaactaaacaactaaaacagaaaaatagtataatcctattgatgacagtgaaaagaatctggtatttacataaagtggcagacccagtgttttgagacccagtgtttggtgagtgagcagagatatatatatatatatgccatatttacactcatttccattttaagattgtacgttataacatttatttaaaaatatacaactatataagaggtcacaacagaccttaaacttacaagattaaaacggttttaaagctctagttatttggactttctctttggatagaaggctactttaagaaaaagtgaagagaaaaacattttaaaaatttcagtgatggatatggatattttggtatattttcaatgtaaatgcaaacaagctgaaaacataccccctatctccacttaggcccaaatactgaattgagggtaacttacaaaagctttgtaatcacacgactggaagataagcttttctgggtgatgctgccagtactgtaccggggtagaggctgtggcttcattcggaggtcgcaaggtaatggaaggttctccccagtctcctgtctgaaaatgacatttattctagaggcaatatgagcagtcagcaaagttcattccctgtagctaccctgagctcaccttacacacaggtgctgtgaatgtaccaaaatgcatttgggtgtcttatgtgaatataaatacttggttattacatttttatatgtattagcatatctctcaaggctgagttaatttttgaggtgtggagttgaattattctatttttagaatgacatcctaagctaagtcactttaaaataaaacatgaagatattcataaatgatttactaatcacaattttccatcacaacagcaaaggacacacaatctttaaaagaattttgtttttaaacttgactgaaatttttagtttgaattgctttcacattcagaacacacagttctataaatttcagttcccaaatatgacatgtactagccactttgaataattttagatctctggagaaatggtagtgtaagcatgatgctaaacaaaatttaaaagaaaaatttactaatgggtgacactaatttctctcatctgaattcaattgcactgatttaatgatgctgtctcagatggattcagctacttttctcagaaaacctaacgtaccaatgaagactaaacagtgaaatgccaagtttggtcacatgtacataggcatgtactttgaggattctgattcacaaatacaagcacattcccaaatgatggtatatcatatgatacagacctaaaacaggaggacctcccatcatttcatttatcattttccatgaggttagcctcaacctgtttcatcagtataatagcttaatgtgagcatctataaagtcaaaggccagtgttggcaggtattttctgggctctactctgatttacatactacgcatgagatatttcttactctttctcctgggaaagatttggatttttccaaaactcagttctttgttctcaagtggacataactaaaactaaataggcagatttctagagtgactctcctctaacctagatttggctatatatagaactatgagaaattacttttctcaggagttggaagagtgtaaaaaggtctcataaactccaaaatcaaataaaaccttggttagagaacaagttccacagaagtgctagaaagtgtgttgacacactgtgggatttcttaaggagaatttttaaggagtctaggacaagaatgcaaaattttggatgcagttgtatgttttgggagagaaaggaagttctctgctttattaaattctttgaaagaatctagaaactccaaaagattaagaaccacagttctctaggaatggcgtacatagggtgcatattttggggaggagaactagctctccaattttctttgcgcactttggacttacattaggtgacatatgaagtagctgccaatgataaaaagccctttctagaggacttcagtaatgcacaggctttttttttttttttttttttttttttttttttttttagcagtggagtgcctgaagcttttctccttgagatgggtcacttcgactcgcagaagagcaaagttagcatcacgctatttccttggcttctcactgtagttagtgtgtgactagttggaactccttcggcttttctctcctgctctgttctcagccactctccacattagttttgttttcgttgctgatttacttttacattgcttaatcctcctattccctgtctgttggtattttttatttttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgcaattctaaaattagattaagtttttctttggcttcttattttgattttttttcttttccttctttctcaaatggctggctctttattctctctctggtctttatttcatctggctgtaacttacttttgaaaaactagtataaaattcaaaatataggatacgtggatttcaatatcattttgaagctgagtgtaataacctttaagtgataatagcttaaaattctggaaacatgcagctatgggttcttaaacaaaagctttacccaaatctatcaaatcatcctctaatctcccccattaaacttctccctccttctcccgctccctggataaagcaacaacaacacggcaaacaggtattgtacatttaagtcacaggtaacactgttaacaaaacaacagaagtttgcatgcaactccgtggaatgatacaaaaggaggatctggatggcttccaaagatcctttgatccagtgtctgctgatgtgacaactcaaaccaagcatcagatcttcatgtgaaccctattacagttcagcagaggtagaccttggccaagctcaacaggtagttttcaaaaaagtctgaacacggcatgagctggtggtgccatgagttgcagggccagggctgggaacagggctgggggtgggaatgagttgggggaagctagggttatgaaaacatttcacgtgttagtacattaagcatgcaaatcatatgcaaattcattctctaattgttccattaactcacacacttttataattaaactttaatgtgagttccatacatttaaagccagagccacagccaaatgctgatccaaatatttacgtcatccacataagttgtagcagccattgtgggaataacaagccccagcacatacattccaatctcggtctggaaatcactgaaatcccttatttgataaccactggaagaaattagtggaacatccacttaaatctgtttagacagcgccatcatctgctctcccatgactccactttgtccaaaatcacaaaccacttgctttgaattcagagtgatctgataggattttccctaggtgctaaggtgggagataattacaaggaaaagaaatataatacttatttcattttctttgtggccttcaaatattgcttcagtccaaatattgtcaaattccctacagggactgaatctacctttctggaaagagacactgaattttatcagatttagtgctatttccagaaattcatttttaaacagagggaaaggtgttcttaagattgaatttattagaaaataaatttcttttctgcctggaaattcatcaacttctctccccacccctgcctattttttttttttttaaacttagatctaaaagtatttagaagactcaatttgtagatgttaattcttctttttggaattaatttaatgggaatggatggactccaacaactggacttaacattacactgtcgtaaaggacaggtatgaccttggcccttggctgggattcagctgtacctggttgactcccagtaagaacaaaagagttcagagaacaagggtgccttaggtctcaaccctcctggaggctgaattacagcaggaatgagctatggaggaattacgtagagtagttactatatggaatggaagaagaggtcaaaaaagaaagatttttgcctcatacataaaatcattttgaactttgaagcctagtgttaggtcttgttgactagtacattcatgtctacataatacttgcatctcctcaggcaaatatttttaaatttagtaattttccacttaaaaatccttattaaatattaaataacagacctaagaagtcttttgccacaataatggtttataatcaaagcttatttttaatgaaaagcagacctaaacacagctaacaacgcaatatttcattagaatagcaaaatgaagtaggaaaagtttagggtagaattctgtcatattttaaattattattgacacagtggtctttgaaaggattccttaagtaatcacaaatgagaaatcaaaatgattcaaggtactcctaataaatgtcttcaggctatctctttggcacttaaaatatttacagaaaatctttcctttaggttcatgtatttgaaagatcttcatattccaagaattttgtcatggcttaaaacttcatttatttggtatttattattattttttatatgtatgcttaaggcctttttttttattaagcacactaaagaacatcaattaaacagaggaaaatgtacatcattagctctcttcttcaaactcaaataaaaactaaacttctaacataaaggaaaaatactttgacattagaattttaaatggagaattgattctgtgtaacacatgtttgcaactgccaactataaatctgtagtctgggtgagtctgaaggactataattgggccacatctaatataatgtaattaaattaaacattctcttataccaacaactgaaaaatacaaaagcatcaatgggatttagttaaaaaacaaaaagcttcacaaaatacagagatttttactggatggcagattccaaattgcagcttttaaactttgcattatttcaacaggtggtaaatagctgcaaatttttagttcacatgcactggacacctacagcaaattctaaaacaaattgtatcaggtagctgtctccctccaaaagggaaactgaatattacatattctatatgctctgagaatagaaaggaaaaacccttctctatgttattttccgtctttattattatttatttttccaagatggagtctccctctgtcacccaggctggagtgcgatggcacaatctcggttcattgcaacctccgcttcctagggtccagtgatcctcctgcctcagtctcccaagtggctgggactacaggcatgtgccaccacatctggctaacttttgtatatttagtagaaacagggtttcaccatgttggccaggctggtctcgaactcctggcctcaagtgatccacccgccttggcctcccaaagtgctgggaattacaggcatgagacactctaccaggcctttatgttattttcttcttaaggaaaaagtttcctaaggatgtcagtagataattaaaagccatgcttacaacttacttttctaacattaatagaaaagtatggcattttccaagccttgtattattctttaaaatttttaaaaattaggatttaattgatttttaaaaatagaacctttaaaatcttttctatgaggactgctcccacctacttgcttataaatttagatctgaatattaacaaacattagtctcaatttcttcagaacacttaatgaaaaactaaaatgattttaaaggacaattattgttttaaggttttactttcaataattatgacaaatttcagagatgggctacccaaacatacataagatatatgtgattacatttactttctgtaatctctaaggctttgaagaatgctatacacagctctatgcttataaatatgcatacgtatatttgaaagtgaatgtaaggaaaaggcttcccataaacattcacacataatgaaagcaggatgttgtagttgttctttcaaaaaatcttcaagaatgaagaattctagtttgatcaaatgcagttggttatactgaatttgttcctttagatgaaaaagagcagagatggctacttacgaacacataaaagctctggttaacatttatgagtccaagaggaactgctgggtcacgtgaacaccagtaccaggcaatgtatagacaccatggtcctcaagagccagaagtcccatgcacaggagtacatatgtgcctgatgcagcatcccaaaaggcacttcacaaaaatacccgtggcatcccttcacatgccgccccaagaatctgctcagtgattctcaaccaagtgtctcaacctctcagacagcaggctatccaatgggagaaattcaaaagggtgtgaaaatagaatagtattttaaaatatggaacataaaaccccaaacatttaaatgtttattttccaaatagaaataaactttttctaaagtatgcaaaggtgaaatatgaacatttgaaaatcatgcagctcagagtaaaatgggtcacaatttcatacaatttgcaaagatcaattcagtactgtcaaatggaaaaaggctgagaaccactttgtagctgtaaccgtgcctctcccagctcacctccccccacatttgcataaaatgtatacagaataacatgcaaatcatactcagaaatttctcacaagtgaagcacatgaatctttgagaatcattagacacaaagggttgaagagtccatgaatatggggaggtacaaaatggggaggaataatgctgatatatacatgtgtgtatatatatatatatcaatttacccttttctttttcctgtaaaagcaagtttaacacagacgcctggaatgaaagccaaaactcacatgggacatattttaaccatacactttaaaaccaagtatgtttcttgttttaggacaatgtttgcacatcaactaatcacaaggcacagtaaatgaagtataatagacaaagagtctcggagtcaccagacattacaaattttctgcattgccaggacacagtacctatagctgttgacaacactgtgcaacacagtacatagcgcaagttcaggagaagaaaagaaccatttgtaaccttacattatgaacctgatggatcgctgagaaaggaaatcctgcgttctgattcgtccatatttcacagacagacgactgctgatataaacagaaaactatcttatcttgtcaatatttaaaacatggcagctaccaaggtagcatccaggaaggaaaagaggaaaataataaaatgcaaagaatcacatttaaaaaaaactcaaaaaatgttttagggtgctcaaggtttaataattgacttccaagtcattctttttgctttaaaacattttgagttgactaaaaaaatcatttatgcatttatgcaaggaaaattaccaataaattcatgccttggaaaaaagcaaactgtattttatatttgccggaaaaccagaaataccttcccccttcacgtcactactttcagaggataaatattttcatcaacttcaggaaaaacaggaaaaaacctttaacacaggtccgatatttttattttcttatcttcaatgaccaagagcaaacagtgcaataaaatgacttttcctgatttagtcattgctctatttgacaaacctagaagatatttatgcctccagagttcttacgggcaaaactcggtagttaacaaaggaagacgtgtcagcttgctacccagcactgggaggagtgaaggaggtggcaggaaggaggctggggcagggaagaactgaagtcagggaaattcagttctgttcctcaagcagaaacccttgggaacagcatttgggagtctaatgattcagctccataattctggctctcccccacaccattaataagataaacttatcagtaatgtttgctcagaaccaaacactaaactaaccagcatcccttcccaggagttacagtagaaaccttcaaagagaccgactgagctcttggcttgacccatcccaagttctgttcccgaatttcatcattctaaaagacactgtgaaattaaatcacagaaaatggcagagcatgtaaacttattcagcaagctctgtgagcatctttagcattcacaagcagtccgtacaaagatcactgcaggaagaaggcaagcacataaccataatatggttaagaggcccggcaaagaactgtatcatcagcaaacaaatgatagaaaagaaggcttatccctagctaaaagtttcctcaccccagaaacgctcaccagcaatttaacacctctctctctagttacaactgcatctccacacacccctacacctttgctttccatgtcttctgttaaccagaggcttgctggggatggttaaggaagttagatccccagggtctgaccaaaggcacttccaaacacctttcacttaaaccagctctgctatcctcagttccctctctaaacttcatgctattttatacatccatagagggttcttcctcttcttacctttctagcaagttcagtcttagacccattcactctgttggccttgtctccaatagctctcctctgatttgaatgtactaactccatgcgttagctggattaccatcttaagtggcatcctcacccagtcctgagctaattctttacacaaatcacatcttctgcaactttcacacacttctagtgttaatctagtgctagaagtgcttctagcacttctagtgctaaataatccagagaccacctgtcatctgatagatgaagacacagacatttaaagaggtgaagtggcttgctcaggtcacacaggtgagtggcacaatgtgtcagcctgctgggatggctaagaaggagtgtgagcctggtactgatgtcaccagaaggcagagggccactccagctatatacagcttggttctactgaccctgaaatgaacagaaactaaaaataaaatcgtaagccccctcaccgactgaacggacccccttgtggccaaggggaccccagaaaaaccttaaaattgagtttctgaccatgatgggatgggaggtgagacaagcctcattatacctcctctttttcatggtttagacacaacaactgatcggaattaatgttaaaatagacatcataagagtgacagaacagtctctttgtggctataagataccaaattatcaacaggacccgaggccatgctaggcaaaggttaagtcacgcacccctatacctaaagaataaactatgttccaactgccacaaggtttttctttttctctagcagctaaacaggtactggccttaagagaagcaatatttaaacaatttgcacctccaccagatgctgattgacccttagcccctgctccaccagccataactacagctggacaagagattgattcagtaactttatccaaataagattactaaccatggactagttctggttggtctacagagattgcacacttgtgtgccttcatgtcctgaaaagcccttctgacgaacagggctaactgtaatatatctacatgttaagtctccaacccaaagtgaacataggccacatgttacatgcatgttggttcaatacacatgtgtcaggaccaccttcatgaatattcacagctcttgtaacacattgaatatatgtgtttagctaatctgttcagcataaatcttctacctaagcccttttccttcgaagtacccgtctctggggtcttggttggaggtgcttcccagcctgcgggatggccatcttgcaggctgtaaccctttagaagaaataaagtctcctctactttactaaattcatatatatatatttaagttaacacaagtatatctaaatgcaatcagttcatgagacagtcttaactgcactggggtccaaacaccaaaaagttgttttaggttgttttggttactcccaaaggggccatgcccagtctgcctgcctgatgggcacaaggccatttaaccttttgggcagactgcatcacttcctggtcactttgagtcatgaagactccattttgtatgaaatccaaactcatatctgattcaaacttttccttccctccttgtgtgtcagtcttggggcttaaaaagcccggggtggataagagaagctcggtctgcgctttgacttctcctaggagaggtgagggcaggtgtcatggtctaccttggatgttccctgccccaagctctacctacttcatgtgtttagttggggaggaagaaacaggaaaaggacgaggtccctttcttgtctggctgttcctctggcagccgcactgcttttcagctaacgttaacatggtctcccatgtgctctacgtagcagctgctccaacctaggttctcctgtgtccccgtgtgatttctttggagagctcttctaggatagagggcaggtcctcccactgcacagtttctgctggcagaaatctgcctctagcttgacttcttccaactcccactcagccctcctaggacacatgcatgccccctgaaggggacccagggggacaaacataaccccagactccttctgcacatccatgtggcccacatgatatggacacacatccttgtcacacagaacagtagaagggcgggctgctctgtgaacactccccctctctgccagggcatccctccccaagactctctgtgtcagctcggtaggtgctatgtgacctgcctggcagaagtccaattatggataccaaggccagttttccctcctgcaggcacccccaagccagatgtacattcctcctggaccccttctcaccaggattggagagcacgggaatgcattctgtctcctctctcatggcaaaggaggaaaagccttagttctttccacaggactcagacaattccctgtccttctccagcactaaccaatgttctgcctatgtggagaggtagctgacaggggcagggcaggattcacactgcctccttgtaaaccccgaactaggtgtctggctccatgattgatagctttctctttagggtgtgcagtgcttagtacctacaggaaaattcccacttagcatcctgggaatagatcttccaatagtgaatagatctttcactactcacagaaatttaccagagttaagaagggaaaagaggatcctacgccatacttatttcattaaaaaaaatcatataaaatttttctcaatgaagaataaagaacctacccctagtcatatacactgagagttcatacatggcttatgtacattttttagatgttataacaaatattttctatttataagctatgttgtaaatttagagaaagtaaaacctctataatttctaataccgtcatgcacaacataacgatgtttcagtcaacgacagactgcatatgctacaggggtctcacaagactacaataccatatatttactgtaccttttgtgggggttggaagaagtaaagctagagccagacttaggtatgtttagatacacaaatactcaccattgtgttacagtcacctacagtattcagtatagtaacatgctgtacaggttgggaggagcaataggctagatcatatacagcccagctgtgtggcaggtgacaccatctcacgttgggtaaatacacactatgacgtttgcatgacgaaatcacctaacgatgcatttctcagaacgtatccccatcattaggttatgcgtaactgtcatcgtgtcagtgcaagtggtaaaaagtcagaatttaaaagagtttaaaagcagttgtgtttgagttgtgaaaattattattttattttttttgacacagaacctttgctctgttgcccaggctagagtgcaggggtgcgatctcggctcgctgcaacctccgcttcctgggttccagtgattcttgtacctcagccactcgagaagctgggactacaggcatgtgccaccatatccagctaatttttatatttttagtagatatggggtttcaccatgttgcccaggctggtggtctcaaacgcctggcctcaagtgatccacccaccttagcctcccaaaatgctgggatgaaaattatttttttaaaaaatcggatgcattccagataccgcagtagttttgttagcagtaaataatttgtcaggctcacagagcaagcgacttaaggcagacctgttgtaactgctgcattcataatatgaaatggctcttctcctagacatagggtcattatactgagtgctggaattaattttttaaatccaagagtttccagagtagaaattaattatgtttatgaaaataacatttcagggtaaaacatgtattgaagtactgagttttgaaaagttttgagaaagaaatataataccagtcataaaatttcatctggggcccaaattcctagaaaagtagtgagttaagtttttttgtttttttttttttcttgagatggagtctcattctgtcacccaggctggagtgcagtggtgcaaccatggctcactgcagactggcccttccaggcttaagtgattctctcacctcagcctcccaaggagctgggactacagggatgcaccacttcacctattttttttttttttttctaaatgtgtagagaggaggtcttgctatgttgcccaggctggtcttgaactcctgggctcaagcgatctgccttcttcggcctccggaagtgctaggattacagttgtgagccactgtgcccagtcttaaatttaagttttgtttttttttttcttttttggtggcattggagacagggtcttgctctgtcacccaggctggagtacagtggcacaatcttggcttactgcaaccactgcctcctgggttcaagtgattctctcccgggttcaagtgcctcaacctcctgtgtagctgggatcacaggtgtgaaccacctcacccagttaatttttgttatttttagtagagatgagtttcaccatgttggccaggctggtctcaaactcctggcctcaagtgatccaaccaccttggcctcccaaagtgctgggattacaggcatgagccaccgcacctggccaaattaaactattttgtttttttagtttttgtttgtttgtttttgagacagagtcttgctctgtcacccaggctggagtgcagtagcgtggtcttggctcactgcaacctctgcctcccgggttcaagtgattctcctgcctcaacctcttgagtagctggcattacagatgcctgccaccacatctggctgatttttgtatttttagtagagacaggtttcaccatgttggacaggctggtcttgaactcctgacctcaggtgatctgcctgcctcggcctcccaaagtgcttggattacaggcatgagccaccgcgcctggccataattaagctttacaatgtcttcatctgtaaagaaggagaatagtacttgacctacttatttcaccaagttgttgtgcagcttcacgagagaggaaactttttcacagctaaatgtttagggcttggaacacagaaggaacacatttttaccgaatgaatggaatcatataacacattcaaaaggccttggtaaatggcaaagcattatgcaaacattagtcactaccgttatccgttatcatttttaactggtctactctattggtgccacttgtgcctttcataagctatgtcactgccaacacacttccggttaattgtaccagaaactgctgacttcctattggaagattcctcatatttcctgataaagacagtaaagggctgccagcttgccgaagagagaaggaacatttgtcattagcatacctaggtgtcaaaaggctgcttgtagagcttagaaacagttccatgaaagaatgttaatcacccctttgcaatttcatttgcctattttctctcaatccctgtcacatatattgcaaagcctcatttagtttttctgaacctgaattactatgaaacccaaacaaataggggtaagtaaaggtagacttacaactgagatattaccaataatttaatgtttacttctttgatggtgaagtcaacacacatttgaaggtgtataattttatcttcagttcagacctctctcttagctctggaaatgttttcttaaaatgcaatgcatgtctcgctcttgttaccgtcttatactttcggttaccatgacttcagctcagaaaatacaacacaactgcattcaaatctaatcacaaaataaaaagaatataaccaatttccaaagttttcctcctaaaggtggacttcctttttgatccagtagtttacaataaattatctccccttcattatggtttgtcctctttcctggagcattctcagaaattgctataacatcttccatcaaaagcaaacaaactccttcccttgccccaacatcaccctcggtttcctgctcaattactctaatcttctttaagcaaaactccctgagaaatgtctagatggtctccactttctcttttcctgtcctcatctgagcccactctactgaaactgaaacaattttctattttccttgacctatgtgacacccttgatcactcctccattccttagcctctttggctgcttcctgttatctgagcatccctggagtgttagtcctcagtcttcccttccttcttggctatactaggtggtctcttccagttgtgactcccaaattcatatttccagcccagacttcttccctaaattcaagacttggacacccagctgcctgcttgatgcttctccttttgcatttattaaatcagctcaaccttaaattaaatgtcagagaccaagctcctgatgacctcacctccctgtgagcttccttgttttggcaaatggcagccattttttttccagttcctcaggttcacaatgctggagctctcctttctcctgtatctcgcattcaatccagcagcaaagcctattgaatctacttctaaaatttcaccttcctgtcactacttgctccaagctactcccttttctcgtttgatttattccattggcttcttacgggtctcactgctgttatccttgcctccttagtatctcttctcagtactacagccaaaatgacccatctaaaatgaaagccaggtcattccactcagctccattcaacacagaagataattcagtcctaacaatgacctgcaaggttctccgttctctggtacccacactgctctacctccctaccctcctctcctacccatcttcgtcttgctgtctgggttcttgacagcaaagcacattcttgcctcatagcctctgcatttgcttctctttctgcctgacatgttctccctctggctactataggcctagctagctccctcacttccttcaagttctattctaatgtcactttttcagagaagccttccctaggcatattacatccaaattaagtctgtgctttccactctataaaagaattattctttcaagcagaaattatttatttatttatttgtttgtttttgagacagggtctcactgtcacccaggagggagtgcaatggcacgatcttggctcactgcaacctccacctcctaggttcaaatgattcttgtgcctcagcctcccgagtagctgggattacaggtgtgcaccactacacctggctaatttttgtatttttagtagagacggggtttcgccatgttggccaggtctcggactcctggccttataggatcccctcgcctcggcctcccaaagtactgggattacaggtgtgagccactgcacctggccttaagcagaaatttaaaatgtaaaaaatgtttggcacataagaacctatctccctgtcaccctgacattcatgcaaaagtagttactggtcatctactgtgtgcaaggcctgggtcacaaagtgagtagggatcaatcttgcttttaatcaacgtttatggcatgaaaattgctttctccgtggacagaaccagtagtaaactgggactgacaggctgatggtgggtctcagaacagagcaagtagatgacagctccatcaactcgataacccctattaagctctggaaagcttctgggagtctgctgatattatatagctaatctaataaagaaacttttatgaatagagccctccagtcagattctaccagagatgaaattttctgccgtgttctagccctgaaaaaaaaaaagaaaaaaagactttttctctgtttctcccttatgtttgtcataatactttcaacacttcagggtattcagaaattgaccagaaagaaaccagcaagaaatatgaaagtttcagagtgaaagctcaaggaataatgaagtgcattccttcttctggatgatagtgcttctaaaagaaaatgaaaacagacttgaagagcaaacaaaacagcttcaaaggcagaagaaaaaagggcatcccagcaaaggaagccttagccaatagccagcaaactcagtggctccttgagcagagactgggatgaaatgagacctgtcaaaggatggagtcaaacaaattcagtgcagtcaaggggtaacgcaccaaacaccttgtatgcatattttctttcagcagtgacagccccacagttgcttcttctgtgggcattaactgaaccctgcctggaaaatcagaaaattagagccttttgtttcttgtgagttacccagaggccgcaggccagcatctgattacttcttcctgcccaccatcggagacagaggaacactcctccttctcacctcttgagtgagttttgagatacacactcagtcctgtaacaactgcatgggatttagattcttctctgcaaccacactgttagcttctcaagttccctgtctgtgtctatttatttctagttctaaagtgtgaaaaagttatgcatgcacccactgaccctttttataaaaggtctcagctgaactatttcatttgcaggaaatgctagagtcaagaaaatgctgcttcctgccatttctccatctttctgaagggcaatccttccaaaacttcatgatcgtgaccttcccctgtgcctgtggggaggatttttggacagatcagttatcacctgctgggaaggaaaagccaggccaacagttgtttctctaacaacatctgcacgtgtgacccatgattgctggagtcagcattaatcaacctaccaagagtgggaggaagtaaacaacacatttggttccatctaagtccactggcatgatataaattctaacactgtcttcccaagtttaaggttttccttccattccctttccaaactcccttccctttcccattcctctccagttccctccctccctccctccttccctccctccctcccttccttcctctcttcctctcttcctccctccctctttccctctttcccttccttccttaactctaattctgggactgatatcacataaaagaagtcctcggctactaaagtaggagagaaggagagaactataggcttatgatattcctgttattcatttgtagaggtaatatataacctgtattccctaatatgacagctgtagccctaaatggcattacacaattgtttatgaaatccctttacaagaaaaaaatagagcagaggaaaaaaatgagcattgcctgtacaatccagctctcattgtgcagctccccaggttccagggatgttgcagggaatttgagtcaattgggatcatgctgtttatagcaatatgggctgttttacttgttctacctcaaagtctggatgctatcaaacgtttttcagggccactaaaaagcagaacattaataactaattcagaaaggcagtgatcagctttttatcataacatgaatggctgaaaaaaacctagattttgcaaagtaatgttgttctttgtaacatctctttacaatatacattatattcctttcttgcaaagtgaggttgtcatttcctttacttaaattcatttattaactggagcccgactgtttgtttcctgcttctgacagaaaagatgcattgggcagagtcatttattcaatgatgtttattgagaccccaccatttcttcattttatccttgtgaaaaatatgaaaaaacaaggtgcagttgaacaatcctcttgaacgatgccaagctaagaggtctctagtagaaagctcacagtttttttttcaattctactttaatcaacacttcactcaatacactgatggatgacttcaaaggtttgttgttttgaggtaagattcttaaaatgagcacattacatagttgaaaaggatcactgatatactgagtggcaactaagtcttagaaaggtcttgatagactaggattattggatgagtaactttataaaaactgctttatctggaaaaggataatgtaaatccagcgctgctgagaaaggaggcgtagctattgataaaggctgggaaattttcatgaagaaaagcacagtaagaatgaatgacatgttaatgttgatctgcccagagctggggaaccaggatgctgtacggcccacatcccccttatcacatgggattggcaaggagctggagacatttaatatagtgaagggaaaatatcaaattgtcttcagtcttaaaaaaactcttcccagcaaaagggagcagatgtattctttgttgtttcagaagatatcatgaactatgtaggagttatagggaggcttatttcaattcaatataaggcaaaagttatatcaactagaccttttccaatcatggggctgccttacaaagagcgggccagctttccagtcaagtttaggcagaaacttgtggctgtctgtaaggatgtattagaatgggtgcctgcatcaattaagagatgggactacatacattttctggccccttctcatcttaaaattctctgcttttctttaacagtacagttggtcatctgtattctcagttctgcattcttctgactgcacagaagaatcttctagctattaatgcatacagacaaaagcaagttatcacaaattttgtgatcctgcattcaaacctcattagaatagaggcccatacagaaaggaggtcatatcatttcacaatgctttacatgaagcaattgtttactatctctgatttgtaaagaatgaaaaattggatgtcaggagcaaaggattttcttcaaatacaatgtttatccatgctactttagaggtttaattctctactgaagttgcatttacataaggtattagatattcttaataggatttttcaaggaactcaaaacattgcattggagcatttggggttttggaatttctggaatgtgccacgtccgctagttcccagtttgcagagacaatatggggtgttcatcaacactgtggttcacacgacagctgtgaagctaggctgctggcattggaatcctggttctgtaccttttaatttttgtggccgtgggcaagccacataaatgctccatgcctcagtttcctccttataaagctgtactaatcagtgctggctctgacgatgatgccgatgaatcaccaggcctaagctagaccgatgatacgctattgttccaggcagtgtatttccctaaaaaactggagaccatctcaatttgtgtccaatctgatctgtcgtagagccctgtggttttatgatgcctatagccttacataaagtaatttggtcaacagtatttacagagtgtttattttagaggaattaaaaaatgactacggaagagtgaggcattgcccccacatagccaacatacactttaccaaaaaagaagcaaacatttaaaaatgaaatataatgaaatattttgaaatacactaactcataaacatcctttaatttttaaaagtatttaagtatggatatcatccataattccttttccaaagagcaccagtgttaactaggttataacatgaataggagcttcttggacagtgtttgctttcataaaaactatgatttccaagtcagtgaagaggtattagtttgggcttacaagctggaaaacagaaacagttttgcaagatgtagctaaacatgagatttactttaaaatgcatttactcccagatgcagttgagaaagcataatgtagaagaaaactagaagttatctcaaaataataacaataatttctaaaacaacccaaacgtatagtttcatagtttgtaaaacacttcgaaaaaataccattttatttgtgcctcacaacaatgatgtggggtgggcattaacctcactctaggaagagaaaactaaggctctgcatagctaagaagcgtgtccaaggttacagaggaaatagacatcagagatgggatttttcaccatgatctcatttcttcaaacctggcattctaacaaagctcatcaaattaagtatgaaaaaatgaaatcaatactcatctgatatagcaattttccatcagacaatctcagaattccaaagtcagagtggatttattcagatgcccattattgctatttctgcctgcttagaaaccagcccctcttctagcagcagcggcctggctgttcatgggaggaggtgcctccttactcctcagtccacattgttcacatggagctaaaaccacccctggtgtgggacctctgtcttgctaatcaatctgtctgtctgtctgtctctctctctctgtctctctctctcacatatacacacccctttgcaattagctcagggaaggacacttgatccaatccaggctcactggaactgatggaacgtaatactgagactttttcttttttgagacagagtcttgctctgtttcccaggctggagtgcagtggtgcgatcttgctcactgtgaactccgcctcctgggttcaagtggttctcatgcctcagcctcccgagtagctgggattacagacatctgccaccatgcccagataatctttgcatttttagcagagatggggttttgccatgttgcccagcctggtcttgaactcctggcctcaagtgatccaccggcctcagcctcccaaattgctgagattacaggcataagccacgatgcctggcctgggactttttttttttttttttgacactcttggaaagataggttctctttcttgtaacttcaagttaaacagcaatttggcttgaatctctccacacggagagggaggctctttgggaaaagagccaacacagaggacagcagagccaagagaaggagagccagagagcaatgcagcaaaacagcacctggatccaggactcctgcccttttctgcttaagccatcttgagttggattttttgttacttacatgcatctggaaaagtccttgctgataaattactttaggcctatacgcacagaattaaccaagacagggccacacaaacagccctatttctactagatgttaaaaaaccttctttttattttttttaccactggaaaaagaaagggaagaaggagaaggagaataagaaccagagaattctcctacccttgaaaatttagcaagggcagattataacagccaaaactgacctgtggacccaagaactggactgcatgtaataagaaacattctgaaaatttaacaagtggaaaaataacctgctgggcctctttgtgaacaagctgctcaatgtcaacaagcccaaggcaccactaaatatcacaaggtcaattccactgaaatagggtttttatatattgtcagattttttgtttagttgttttgaaaacagaatattttctattgatatcttctttttctttttttaaatccatggtctggttttaactgcaaacaggacccttggttaagcaccagcacatggagacaaggtggagacgtcagagcttctctagcaaaacgactggaggtgtttagggctgacgggtctatcagaatcaactctggctaatttgccttcttgatgaccttgacagggaagaaaacaatctagacctgtaagatgagtatcaaagcctgaaaaagaatccatctgagtgattctcccacttcttccaattatttgttttaagactatagtacagtattcacaagacactaatcatattgacattagtgttgcccaaaagacacttaatcatactggaatttctaatcccaaagttgtctcagatagagcagggtgtatttgctaaaagaaaattaactgaccatattaataaaaaaggtgtacaatacatcaggtttaaattccaagtatggaagcgctattttccacttttgtgttggtcatagctggctagtggcctagagttcttggcttgaaatagggcacagatatcatcaacattccagatgatctctgaagctcgggtgtcagcttgtcaacttgacgagctgtcaaatcggaagctcctgacggaagagcttattgagtgcactcttgaccttcttttttggttatgtatgatctgtctgtgcttaagtattaagagttgctctttagaccttcatggaaggaaatgttgaaatcatggacaagctgagcctttctgagtagtggctatgtgatgaaaatctaaattaaatctaggcattaacttacggacattaaacaaaaaatctgatgtgacacagtaataggaaaacttgtttagtttggggaaaaaaacactctcttttctttgagacagagtctccctctgtcactcaggctggagtgcagtggcaccatctcagctcactgcaacctctgcctccagggttcaagcaattctcctgtctcagctctcctgtctcagctgggactacaggcatccgccatcatgcccagctaacttttgagtctttagtagagacggggtttcgccatgttggccaggctggtctcaaactcctggcctcaagtgctccgcccgctttggcctcccaaagtgctgggattacaggcgtgagccacggtgcctggccaaaaaagccactttccaaaatgctgttcctttcttggttgtgctattttctgaaaactgattctgtaaattccagtaatgccagagcagtgggtagaatttctgggaacaacaggcctattctctcaggaaaagtatataagaggagaagttactgtcctacttctttcccagacatggcaaagtgtttgcctcatggctttctgggatatccatgctttttaagctaacagttctgtgcacaatatatttccataaagttccaaatttcacttaaagaaaaaaaagccctctcacttgatattttatctaacaatgttacaataataacgtgttattaccatatgatattttttgttacaattttgtaacctgaattggtagagaaatatggcatccattctctgctttccctggctttgacatcattctacccagatccctctgcatcgtgatatatgctccttggcagatgatgtgtttacacaattaaaataataaaagaaaaatgcaaattccattctcaatctacatgctaaatatgggtaacactggaacaaaagatggtctttatagaatgctacaaccaccggagcacttgcccttcaactctctttgtcattaattggcctacaatgagcagggacctttgaattagggactgacaggtgatgggtctgaaccgatagtcatatctgtctatatagtgctttacagtttagaatatgctttcatataaattatctgatacatacaggcctgagaagcagacattatccacattttaaagacaaaaaaattgaaattcagagtcaccacataactcggtccaggtcacacagccagaaagaaaccaaatcagaattccaaccgaagaagccactaagaaaacagcatcgactatttggagaaacaccacaagcaagaatttgtttgtagacagagttaaccccacacctacctacaaagcttttcacaaacatgggagacaggcagcgttctgacacactgtgcagggtctctgctgaaggatcaacaaataaccagtgcagttttgcatttaaggatttcatggtgttaaccacgagttgattcaatcagtttccactaaactactgtgattttctcttctgcttgctgtgcccacataaatggaatctattatggcacatgagaaattagtatttgttgaactgtttttaaaatattttatatcattttaatacagaggcaggcacagggcatcagggactatagaagaacaaggatagggttaggcaggccagggcttgagtcccagctctaccatttaccagctgtgaggccaagcactcaccctgtttggcagatgtgcacataggctcttgtgaggattaaataagatactgcatgtgcaatcccaggcatgaacctggtcacagcagtgcttctgtatggctcagcttctacttcccttcctttaataatatcaaaacaacaaaccttggaagaactaaaatgtaatatacaaaatgctttcaaatagagaagtaattgacctagttgtacttattaatactatttagattgagaaatattaagcttgcaactgaattaattttctaataatttagaaaaagtgtctttagtgcccccaggtaatactgcttttttttaaatcttaggcaagagcattcaaaacataaagattttatattacacactattctcactaatatttaagctaaagtttatgcaaagatatgcatttcttttactgttgagaagcctttgttttgtgaaaatacaagtactatttcattttctcatacgtttttctgtaaatggaagccttctataaatggcttaacttgcagcatttggaaacttttttttttcttgcatgagtttggagaatgtggccttaaccttattcattccatcactctcttattgttcattttaagggtacttcgacttctaaatatcattcaagaaaacttctgaagactgcaattaggtcctaaatactgaaaatattttcctccttctgatatattttccatttactatctcatttccacataactcagaattaaaagctgatctgccatgtgctgtacacacattaatagtgtgtaggacaccttgtttgtgctaaaatgagataacagatgtcaaagtactttgagaatttaaaatcactatgcacattaaggtataattacacatatgtgaatgcaacatttatttattaggggtgtggaaattggggagtgtttcagaacttctgggctaatgagtccagtttagaattacaggctggagaagctatgttttcaacatgataggaaacccatcattcagatgtatttatatcattacattcagttcatgctgaactcaaattttgtttcttgcatattcatttaaaataatttgatgccagagtactgcttatatcagaataatagcaaacaatactcacaatatttgcaaatcccctgtatcccaagacaggtattttaaatattgtttcaaattgaaaaaatcaattaaaccccattctagtgttttattttaaatatctgccaacaaatttaacaggtaaaatggacattaaatttatctcaatttaactttaagcattgcttttccaagttaagcaaagcacctccaaacatctggtaagcagacctcaagaaggcaaaactcctaatgaattattgcggccaccaagaacttaaggtttctggcccagggctagaattccaaatcactctaatggtagctcagctaaacttgaagtagaggggtttctaagaacataaatctgtccaggtgattttctctcaactgcattctcatttcttttagtaggtaagaaagaaagcctgaaggtggacttttgcattttagtgggaaatggactggttaggcaagcattaaccaagctacagtaagcttcttgggagaaactccttgggaaagaactggaggaatggagctccaggttggaaggaggtataactggctgcttgcttgcaaaaattttaattgctaattcaagtctttaggaagacccaactcgattgtctaaacacataacttcaggggaaaaagtatggtctagagagatatgacaggtttttaaaaaagtatataaatttcaaaaagtattacagcaaatgaccaaaaataaggtagaataagaaaaaaacaaacatcaattgagtagttgagtggtgaaaagtcacataaattgaattattcaacaacaagatgacagagtatttcatattttgacaggttaaagcagtatttttaagaggtatgcattcattgctccatgggttttggccttccatactagcgatcatgctcaaaactgcaattaacaccacccagagagttgcagttccagaatccctttttctcattgatcagattcctgtggtgtcatctcctattttctctgcagcagaagtgctgtattgaacagcaggcttttagaaagcttctaataagctcctgatggctgatggagcctgtgtgtctagcagtcactcgatcatcgttagtactccacatgaggggaatgcatgcgtgcacaggtgctctagttcactacgtcccatcagcctgcttatctcactctgttttctgcttttaggcttttttcacctggccagataaaagcccattccattttctcaaggcaagacaattctcataagggatgcatttctgattggagtgacccgttaaaagatttgtgctatttggtactactgcccctgctttcgaaaacctcaggcagcatgtaagggtgcagtcttgctaggccacctctgagtgtttatacataggtagaagggtaagtcgttttttaaaaaaaccctgcagtatatggagaaatttcataaattatgtgagcagctgagagaggtaattctgctatactgcggttgacacagtcaataatagctaatgctcattaaagaactatactcccttacccagggaagaaatgggctcagaaaagacccagttcatattaatacacaaagacaacatggctcaaagttaaaacaaaccacatctctgaaatgctgtcattagagaaatttaaccacatatgtgactcgaaaatataacaagtaacgaaataaatgaaaagtttggggggaaaaagctttcagatgccctatttaaaagagcaccagtgaaaacagtaataaaaattaaaagacaatacctagcaacagagaaagataaaattattcttatttctcctatattttccatcccctttcaataaaagagtctccataatcccaacattgccattgcctgcacaaagaacccagagaacaattcaaaattaaaggagctgaaagaagacacagtatcccaggccttctctccccaaggcatctgcaggcagaatagccatggtttccagaacattctcatcacatttgtctctcgtgagctgcagcatacaatgtttaccagaggctttaaaaataaaatctcactaaacagttgagaaaaatatttaacaaccaaggcaaagcaattacagtcaaattttcacctcgagattcccatcttaggtgtgggaggcagagagaagactcctgcacatcagtctgaacctagaatgaggatgaaaagagttgattctgccaatggttgacaacaaatccatatttttgaatctcagggtgaaatgcggagctacccgcccatctgaatgtacattaagaacagcgccactgttcggttaaggctgactcaagtttctaagcagcaatccgaggacaggctagacatgaacatccctactaaaaacatggaaaggtctgaacgtgacagatctcccttttcaattacttgtgctagaaagcatcatcattttcaactagtcaaggtgacaatatgagaaaacgcaactagtcccagtagagcatttctgtatgaatgtatagacttgggaggaaattaaccacatcacacagggttaatccttccccccaaacttctgccccattatccaaccaatttacattttgtaatctagacttttattactcattttcattatgatttgactttgacactatattattcccttcagggcaaagactttctgggtgcaatgagatcagacataatttcttcagcaggaatgcataacaaggacatgtgtacacattccattcccagacatttctgtctcggtctagttcagatgagcaaggaatgaaaggcggggcataacatggtataaattctagttaggcacggacaataagcatccataggaagctactgttcactattaaaaggcattacctgatatggttgaaaaatatcacaaaggcttataacaccttacctgagccatctgcctctccagttttgatcggggaatatcatcaaagtagttttcatttcttctcctccttgcatcgccctgcatgataatgtgaggaacgtctagggagccaccagtggtgtaagtgctttggctaagtgatggagacaactgaggaggagtgtgattaccactgggttcctgaatggaaatacatcatgaaataaataccatgttctgtggctaacctttggtttcaaaattgtgaaatactgacaagacaaactgtgggggtggggagtcgcttttgaagcaacagccaaggaatgaatgacattccaccactttattaatggcatgatctagtcaatacgtttttcccctaagtatttcaggtcaaaggtctgaaatatcaagagtcaggttctgttttcctaaagcagcatcatggatggtctcaggagggaggcacacctatgttgggcacctctgacactactgcatgtgtttacaggggaggaactgggccctcatgtgggcagagcgtcctcaccatggtagatgccatgatgagaaagctaaaatgagacccaatgggtcttgatccttcatcaaagaatggtctgacaacagggttgggaagaggacacagtacggcaacacagcatgtcacacgcacagactgcagagcagtgcatgctacgacagaggatgcttttccaaggcaaagacaactccatccaagggaaacgggtcaggaggaagatagggggcatagacagctcagctctactatttgcaagtagaatgaggattgggatcatggtgtttctccagatcccttctcctccggatattctggaccttctatgatagatttaggtcctatacttttgcatggaaatctctgtctttgatctttttttgttcccctaaatctcttccagagagccagaatgagaggttcagaaggggaaggaaaaagagcagggtaagtagcaggaaatgactcctctaaagagtcattttagggtgactacactgatggtgcttatatctttctctccttccatgtagcaaaatgaaggcaaaacaaaaatcttttttttttctaatttatttgaggctcctctttctaaggggtgaaatttctatttgtacttttatgactcccaaaactctcaagtagcctccaaatatcccagtgtaccctaatgcccccagtaattaattaaaccagtattcatgtagtccctacccatcccactccagtctctctcaggaggctaagcttgtcctcctggagccaattctcttgcatcccctgaaatccttgcgcattttcctctccaaagctgaatcaactccaaatcctaacagctcctttcctgtcctgccctctgttatcctgacagtggctatgctgtttgctgaagtttattgataagaggcagcccactgcatttcatcacgatggttacgtccgggtgccgtgcttgtgttcatctcttcagaaaagaaatcagaagcaagcaagtgcaggacaaaatagagagcagagtgggcaccccacagctttcagggagatctcagcttttcgacgaattttagaaaagttcttgtaggactcatgaacaccagtgactgccggccacttcttgccactgccatttttgcctggaaatcatctttctcacttcctctctgccctttcctccctcccttccttcacttcctctttatttctctctcctttatacaggttctctttagtttcctacctcataatttttttttttttttttttttttttgagatggagtttcactctgttgcccaggctggagtgcagtggtgcgatctcggcccactgcatcctctgcctcccgggttcaagcgattctcctgcctcagcctcccgagtagctgggattacaggcgcccaccaccatgcccggctaattttttgtatttttagtagagtcggggtttcactgtgttagccaggatggtctagatctcctgacctcatgacccgcccacctctgccttccaaagtgctgggatcacaggcatgagccactgcgcccggcccctacctcataattctaaagtgtagttgaataaaagaaatacaatttattaagtaaggttttagattctctattctgaatttttgaagtgagtaaagctggacaaattttacttcttgaaaaacagaagaccctaaggttaattttaaattgatctttacttaactgtggtccttgatcaattttctttctgtgggtttgaggagtctgacagaaaacccatttccgctctcttggcgtagatggggtgtgggatgggaggtgagggagtggttctttaaaggtagtggtttgtcaggctgaattccattatagatggatatctaaatctcaaaaatatatatttaaccaatctagaaaaacaaatcttgttgttttgattgtgtcaaacaatcaaaagacagattgttttctacacagatatggtaaacttcatagaaaagagccagcacttcctgatctattgcttcagttgtataaagtgcacgtttataaaacctataaaactacataaaataattcttttattttcttactctgttgcccaggctggagtgcagtggtgcgatctctgctcactgcaatgctccgccttctgggttcaagtgattttcatgtctcagcctccggagtagctgggactacagacaggcacaaccacacctggctaaattttttctgttttcagtagaggcagggtctcaccatgttggccaggctggtctcaaacaaatagttcttaagataagggcagagaaccagatgaatgtgcttggcacttaccctgagggtgatggaccgagggggcttctgtgggggatcgtcgtgcagcctgtctcccagagatgccaaaatacgtttcctgtggccaatcaaattgatttttaaaacctgaaacaacatatatttgggttaaatatttcactggagaacaaataatttttatatgtcctaaaacatgtggggtgaaaaaagatttgtgcaaagttactcctgcaccatgagatgtggtgtcacttcagtgtgaccgctgaagtccagaaagattgcagtagcatctggaaagcctggagtggctaagtatcaggggcacaaagagaagggaggatggttctccttccactcatgctgcctgagagcctcattcccaatgcagcagcctcaagagaaaccagctcttcttataagcagccgaaacctcacaggataaaatctgagtctggactcaggcttcagagggacaggctgccctctgtctctttccctccatccaggatatgcagtcatgccagcctcctctaggtattagaagctccacattcattctcaccttggggcctctacccctgctcaaccacctgcctggaatgccccctctcccctctgagattttcaaataaccagtgacttctcatggttctggacactgtgctgctgatgtctcctcagaaaggtcctcccccgcctccttattgaagaagccatgccctcaacccctgacatgctctccacgatgatccatcctcattttatcacactctaaaagcactttctttacaagcttagtgtttgtgttttgttccaccctctccaggtaagctccctgagagcagggcactggcatatgtagagcactattatttcccaaaagcataaaaggatgactaaaaaaaaataagggattaatgaatatgaaagaatgaatggtaatagagatgggagttgcaaaattagagtcatcttgcataaggatacagttagaatgaaggactgcctattggggtagactcagagcctccccaggatggtattttgaatctgaccatgctgcaaagggcacatggtagaagagctctcaaagggaactgagaattgcagcgcctcaatcctcagccccattcccggtgctttaccagggccacacccctttcaatcttcccaacttctctatctggaaggagttctcacttgacagatgaagaaactgtggttccgagtggttaagtcacctacccaagagccagcatgtcgtggctctgggatttgaatcagatttgcctgattccaaagcatgttttactccaaagtatacgtcacaaaatttgggcatttctccaaatgttaccagcttcttaaaaacacattgtatattcatccattcataaaaatgtgtttacctcttccctacctatgtgtagtcccaggatataataatcttgttgggtaactagtttccaaagtcgttatcccatgtgtacatttttctcttctcttttcaagttttaagatagaaggtggggagagcgtttctttggcaggcatcccatgataccttgaattttttttaaatttcaacttttaatttagatgtaggtggtatatgtgcaggtttgttacatgaatacactgagtgatgctgaggtctgggatatgaatgatcccgtcaccaggtagtatgcatagtacccaataggtagtttctcagcccttcttcccttcctccctcccctcctttgtcgtccccagtgttcactgttgccatcgttatgcccatgagtactcaacgtttagctcccacttataagtgagaacatgcaatatttggttttctgtttctgcgttaattaacttaagggtaatggccttcagctgcatccatgctgctgcaaaggacatgatttcattcttttttatgtctgtgtagtatttcatctaccttgactttttatttgcctatttgttggttaacttacgggccttttggcctaaactgatgtagattttaaactcacactacgccctattcctttgacagccaccctctgacccatgtctgttgatgatgaggagggtaaatgttagccaaggtgaatgtccccatgcaccatatccctatgattttataaaaccttcatctccccaggctgattaatcctaatctttgcaagtttgttttcataaagcagctcctcttttccataaatcatttcagttgacatcctcaggactttctcctaccctattatagctgcttaaggtttgctgaaaaaatggctcacaatattccaggtgtaagtgaaccatggctttacatttatgcaggatactgttttctgcttttaatacccgtttaaaatgtccttcctaagcacacgtgatttctagctagccttttagctgcagtaggaataaccagggacaaaagtatacactgactataaaatcccttaattttgttatagctaatagttcaaagccctttaatctaggagggatgatttgagttatttttccctaaatttcttatcttacagttgtccaggcagaagcccatctgccatccttctgcccactcacacagccctatgttagctttttgcatttatattaaccagtttggcatttcactacctggaagagcttagtgatttttgcatatctggaaatttcactatgtattcctttcagatgatttataaatatgctaactaagtgtggccctactgctgattacttgcaggcagcattgtttatacgatccatagaaatgcccttatattcttgtattgtttctgtttttaagcatcaagaccaaataattcctccatctcagaaaaaatatgataaccttttcaaaggtattttgcaagtctaaatacagcatattttctaattctcttttattctcatcctcaattcctttgccaaaggcttctattggatataaattcctcccataaaatcttcaccgcctttctcccagcaggtagctggacctcatgctgatggtactaccttgccccctccctgagtcctgctagaaatgttttttataataaagacatttgcttaattattattattattattattattattatttacaaaactgacactaaataacacataactgtggtacaattgagctgatgtaatccccactattgcttttggtttactctcccacaactcaattttgggcaggttacctgactcctctgatctcaggttttctcacatataaagtgaagaagttaatgacaatttcaaatgtggttgggaagatgaagagtaagttgtgagaataaccagcatagtgcctgacacatagaagaagcaactttcacagtgtgcttattccagtgaatgggttctgagggtgcacaggaatcctggcccagaagaacaaggacttgttcattgtcataaagtcaatcatgttaaacaaatacactggagctttggatgaagagatgtggctaaccttgggaaagccctcaatgaagtaacttatcctagtaggaacatggctgatttctagctattagtctgaggccagacccaatttaaaagaatatgctcttctgccatccacatcgcttaatcttcaataggaggtaagctgaggcactcctctgcactgaagcttcattgctgtctcctccatagagctacccagatgagggtggacggatgaatgaatggattgatggatagatgatagatgatagacagatagacaggaaacgaattaacacaggatggttagtactatcaagatcacctggataactctcctttttatcagaaatgagcccccatcactgaagatactgatggtaacttccatttactgaacattttctatactctagttctatgtcctagttgtgctagaaactaccaagtggttatacacaaatataaatatctcctgtaatccttacaatagcatacaataaaaccattctcattttagagatgcaaaatctgagattatgaaatgctaagtaacttgcccaaggtcacactgctaagaggtacatggctaggatgtgcacctgattcttaaccagcccttcactactctccttgctcttcttcttgctgttaacctctataccttttgacctttagctacactattggttatgtcatcatgaggcttcttaagatgttgcttcttactttgagttatcatgtttaaagcatttatatagggttttgagcatctgaaaacattaaaataattcactttttagtaaggcttatagcattgttaaagctacaggctacaagggcaggtacctcacagtattccctgtgaaatacacatatagaccaaggacaggaaaccctcatcacccaagattcaatccgagctggctcactgtggagtggtagagagggtgacagtgggcttcaaaacgcccaagttgacagtaagaaatccaattggcaaaacaataacagagagaatattccaaagaaagatggtcattatggaaaagtcaagtctgaaggtggctgggtttgccttgagtgagaaaggctttatagcagactgtctttgcaagcagatggggttcctgagtagtggaatcctacaaccccaggcatcatgggtgataaccagtgtgaaaactttagttttcaagaacaccaaagcaatggttactgcagtagagaagaattctgtgttttcgttactgtttgggttaaagttaactgttcagacaagaacataatgggagtaaaagacaaaataatggtaatatattggagattcagttattctaagatgttgaagcaattcagttcggctcaaaaaacaatactgaatttctgctaccaattatttggaggattcaaaggggaacgtctatgaacagagcttacaatattggagagatcaggcacaaataactacattatcacaccattaactaagaaaaattattatacacataagcataagaatgtggctccaactgctgagttccaatagataagaaataaaagttggccaggcgcagtggctcatgcctgtaatcccagcactttgggaggctgagatgggtggatcacgaggtcaggagatcgagaccatcctggctaacacagtgaaaccccgtctctattaaaaatacaaaaaaaaaaaattagccaggcatggtggcgcacgcctgtagtcccagctactcgggaggccgaggcaggagaatcacttgaacccgggaggtggaagttgcagtgagccgagattacgccactgcactccagcctgggcgatggagcaagactctgtctcagaaaaaaaaaaaaaagaaaaagaaaaggaaataaaagttatggcatgtgttcttaatggtttttattacaactattgtaagaggaatgtgggtcaaaggcaaggagtattgttgaaaccacaggagtcagccacaggtgggtatccattcatcacagcagtagccgcctccaggaattttctccagtatcacttaaacaggataattccggaaaccccactgtgaatctcagcaacaggagaataatcatgctggatgacaatcctataatatcacgtcactgctgtttatgtttctgggtttggctgtgggaattctgccagacagtatcatgatatacccttacatggaatagcttacttcagaatatatgtcatagcaaagctgaaagtcaatgtacttaaacttccttttttcttttaaaatttaatgtgatataaaattaaacatgtttaaatttatatcacattaaatttaacatgtttaatttaaacatgatgtaaatgaagcatttttatctgcttttaaaaaagtaaataacattttgattataatagctatactgctttcccattttagacactttataaaatacagaaaaacaagtaagagaaccagtaatccacaaactatatctaaatagatatatttcatttctcccccatgattatgttttgtggtggtcatatcacgagtaccattttcgccttttcttcagttctttaaagctaaagaacttttctacatatacaactctcagtagacattttaactaactccatattatcacattattgtttcagagaagtatgtcataattcactaaacatttcccctatcattgaaaattttggtttgtgctcctttctggatagcaaacattccacatgcttaaataattctatcatcctacaatttccgttctcaatgccatgtttacatagacacagcatagaaaacaccaaagaagactgcaagaatcacacaagtcacgcagaaaagtcatgtagcaacagtctgtctctatgttctgcatgaaatctcaatccgtttattgccggctggaccaactcctgggaaaatcacaaacccacataatgttcctcagtgccatattttgcattttgttatgtttttggagttcagatttagctgacagatgtgaaacagcacatgtagctggaattcttcagagagtacacatgcagcgatgctgggcacacaagcgattctagttctcaccaccaggcgactgcatcctttttatttctagattgttattgagggagggagttcatcctgcatttggaactcccttccattttagggggtagattatttcccctttcctttctagatacttggccaactaaagagaacagctcctatgcaagtctgtagagctcacctggcttcagagtagcctcttctaataaaactgcaagtgttctgagcagttctggtgttcctaaatgccaagaatggaagttgcggtggaaactgatctgctttgttctcatctgcagaactaaaattgcaaataattgtcaaagttttcccccctgcctgataacaatttctaaacactttccacctgaaagcatcaaggcaaaagtgcctgtgtaaaattccatttcgaattcctgcaatcttagaaatcctcacttgaacttgcatacagttttgaccatgacatttttctctcttatttcttgaactgcaataatccatgtccagcatgggatggtgaacagaaagacctcaggagcagaaagtcatgacatttggttcttctcttactcttcttctagctaagtaatctttaatgtctttgagttgtaatataaaggggacaataacagtcttattcaacaaatatttcttggatgcctttcacatataaccaccatgttatgcaatttgtgagccacaaagaagaaaaaatatcgagtcctccagggctctcaatccaggcagtaaaaaaatattaaaaccatgtgaacgtatgtgtgtgtatatttgtgtgtatgtatgtaggcatctatgtatgtatgtatgtatctatctttctatcatccatccatccatctaaatatatacgtctacacagccttcccagcctaaaaggggtttctgtggaatgaatgagaatgactaggaagcttatctggaaattataaagcacagaactaaggtactaactaaggtattatttctcttttaagtataacagaaacttaaaactttcttaccctatcaacaatatttagatattacctttgatatttaaatgtgccattatggatatctctgggtagattttagatccagaatcatgccttccacttctccaatcttctctcctgttatttctttgctccatgtatacacacttgtgcatattccagagtgtctctgcctggattttcattagaatctcacaaggatgaaatcgagatccacctaaagccttgcttgctcaccttggattacatagacctttctctctttgaatttctttagtatctgtggtctaccctgtgctgttgacacatgatacatcctggtgggtatagctaactctcttttttttgcgtatgtgtcttacctgatcaactagactctaggcgctgaaaagtcagatatagtgtcactgcatctcagggtccctgaatgcatctagctcacgaatacaactcaaaggtgatctctaagatctcaactcaaacccctgtcaaggtggacaacaaatgaagcaggggagatgtctctaaaagaaaaagagggaaggaaaataacacctatgtcttatttcattccgtttctactctcaagagtcttctattctttctgagctttggcaccttaattcctacacacagtcttgccacgggtgatgcaaaacttccttacatcccaccatctgtaactctttccctttacctctgccacttcatctaaaaaaaatccctctgactacagtttccaaattcccttttccttctgctattactttccaaaccaactgctactaaataatcagcaaataactgtttgacagatgccaccgaaatacaactgtactaacctatggaaaggaaaagaggttccaagttatacagctccagagagagcaaaggatagtgagaaagagcgagggaggaggaatgcgtgttttctgaatgtagtctgtctcattaaataggaaatactaattatgaggaaatgagatcatctttgcatggaaagagagaccttaatggtataattgcctctgaacatttaagggctctggaggtacaaagccttcttttgtaatcaatgagaatcttaggtttatttgtaaagctctctgaattacctcttgatgaaggtactaattttctgattttcatgtaaacattgcttcagaagattaaaaacacacacaaaacaaaacaataaatcagttcccaactaatttccctgaaagttacttttaagtaaagcttgctgccagttaagtttttataggagaaatttggtttacattgctcaataacccaatcattggggttattgaaggaaaaatttgttacaaaagaaaatgggaagtatgtgcaacatcccagatctgaagttattcttggagatgtgaagatgtgctaatagcatctgaaaagtgcaaatctccctgcagtactatgaatacataaaaatgctctgcatcttaagaagtagagagactgctgttttgctatattttgctaaccatgcaggatatttactgctaacgagggtattttctaactttatttcctttcaatttttgagatcataaaatttatgatcaattatattgtgtgactgatgctctcagtattgtaaaggaaattatggttaccgaaattcattaacatatatccatataaaataaacagaaacacgcaacatacatgaacacacccatatttgtaaaagaagctctaagacaaattgagtctcaagagacaatcctaggtaagtgagggcctggttactccgtttttggattataagtggtcttttctgctctgttgctgctctgcccctcttcttgaggtttagctactttaatggcatataacaccctccatcagcagacagaatagtgaaagaggcagtgaattcaatccagccaattctgtttctgtcagcagctctgataaaagggttttatgtgggaggaggtaaaaaatctacctaaaactagctaaactaaagttttaaaaatgcatccacagattttacttagcctagccagctactactgcactttagaattggacatttaccatatttcagctacgtatggaggcaaaaaggatgttaaggttaaaagaaagtattataaggaaagcagaggttgagtcccaaggatgagttcaaaaagaggaaaaaaaaaggggtaacaacagtgagagagatttcttatcgtcccttttctccctttgtccccacccccaccactatccccttccttatcttctggagagtcacatcacagagtagagctaggaatcaccctaaacccataagaatggctaatgttagaaaagaatgaccctacctcggatgataaggatgtggaggaactggaactctcatcttgctggtaggattgtaaatggcacagtcacttttgaggaaactgccagtttctcaaattttgacccagttttctaacatataacccagcaagttgactctagctagcaactcctagctaaaaatgaatacatatgcccacataaagatgtgtacatgaatgtttaagcaacattattcataatagctaaaaattagcaataatccaaatgtccgatcaactggtgaatggataagtaaaatacagtatattcatgcaacaaaatactgcctaatgatacaaaggaatgggctacatgatacaggctatagcatcaacagacctcaaaaacattatgctaagtgaaagaagctgcacacacaagatgatagaatattgtaggattccatttacatgagtttctagacagcataaaactatatgtacagaaaacatatcagtggttatctggagtaggaataggagcagggattgactgcaatgagcataaaggaactttttagggttatggaaatgttctaaaatgggattgtgttgatggttggatagctgtataggtttactgaaatttacccaactgtatacataaaatgggcgattttcatgatgtgtaattaaattgcaatgaagttgtttttgaaaaaagaataatgctgggagaatgcattcagtatgcagtatcgtataaataaggccattcctgaaggctgtaatccaggctgctcgagaagacctctgttgtcttggaatataccacttatcagctggatggaagggtgagcaacatatacactgcaggatgtcttaaggaaaatgtgacctgcagggtagctttgttctaggagcctagtactatttaactataggctaatagatcagtagcatattctttattataagtgcacaatacagtaaattagtacgactttcctatgtatgtatatttttgagggtcttaatcctccaagtcataacacttcagtaaaaatgtttatgctttctaagtacttacaacaaatggcttatggatgtttgcggagtgatcactaggagccaacatgggttctctctggatgggtaacaggtggtgatcatgagatgacactcaagaaccagagaataaggttgcattctaagcaccaaattaatcacatcaacagtgctatgatttgagttttctctgacaaaaactcagctttaaattggatctccaatgtggcagtgttggcagatggggcctaatgggagatatctgggtcatgaggtggcgaatcctccttgaaataacttatgccattctctcaggagtgagtgagttcttgccctggcaagactggattagttgtcacagggatgaattagttcctgcaagagtgggttgttaagaagccaggacatcctgtgggttttgcctcttcacacgtcagcttcccctttaacctttcaccatgttgtgatacaacaccagaaattctcaccagaagctgagcaggtgctggcaccatgcttcttgaacttcctagcctgcagaaccatgaactaaataaaccttttcttctttataaatcacccagtctcagatgttctgttatagcaacacaaaacagactaggacaaacaaagcgactggagtcagaatgactttctagcccatgaagagtcaatgaaatagactggcagtgtgactacagtttaatcggtgatactgaaacccagctaaataaagaaggtgtgccagggtggggtggagaagcaagggtagagggcatattgaagcagtgaaactatctagctttggcagcagcatggggagacactgaatcttaacataagtaagctccctgattactcaaggggttattttatcaggttttgtactgatctaaatgaaacatccctcaaaattccctttccttcaataccacatgtaccaggaagcagtaattgctgaatcagttttctgagtgcccagatatgagaagaggaaatgttgaagacgggggatcagggaggggagcatttggtcagagaatccttcccatcatgtattaacagaatggacatcttgatacattgatctctccttaattaaattaaatccacaccaccgaggcacagaacctgctcaggagggcatagtgattaagagcagggcttggtgtcaggatgacctgagtgtgagtgttggtactggcatttactctatatgccttttggtcaattacttaacgtctctcagtatcacctaacttgtgtaaaatgatggagctaagaaacagtattcgcctcttagtgtaattgttaggattaaatgagacatatgcaatgcatttagcacagtgcctggtataaaatgagcttcataaaattctaacttcattcagtgttttgattaagcccagtttctgaaatggaagggctgagccctcccctggaaccccaccagaaggagctcagcagccagccatgcaccttttccctggcaacaatccctgcatcatcagccactcttcaaactttggtggcctcattgaaaatcagtttttgccaaactttattgactttctttttttgacaggtattagtatgaggttgacagaccaggagaatgtcatagatatagtgtctttgattccaataaagcacttgatgaagtctttcattatctgcaagatggtgggctctatgagggaaaaattaagtggattcacagctggttgtacatctatagccaagaggcttgatgaatggctctgtcataacctgttgggggaccactgattgaatgccacaggctctgcccctggattctgctctattcaatatttttattaatggcatcaaaatagacataagaagaatacttatcagatttttcaatgacataaaactgtgaaaaatatttaatataataataggctaatgtaaaattcaacattctctcaacgggctgaaaaggccaagctgacaccaaaaagatgcaatttaacagggataaatataatgtcttacattaaggatccaaaagaaatcaattgttcaagttcaagatgggaaagatatggctgtgccacagttcaaagaaatagctgaatttttagttaaacgtaggaaggggtttagcagaaagaatgcaaaagtatgggtctaatggggagggaatgaacccatttagaataattttaccaaataaataatctcatttaccttgctattacaacctaacaaggctggtaattaccttaactttagaaatgaattaactgaggttcaggaatttaaggaacttgtcaaagtgatgacaaaatcaggatttgaatccagttccgacttccaaaatttgtgcactttggattcattctatcttgctgccacttctctcccagagatgctgtgtggctcaagtgagacaattttaatggacgtacctagcacagtgcctggctcctaccttctgctcaaaagtggctgattatttttctcccagagactcattaaatgtaaggctgggtgcttatatgaacaaccagtactttattattataatatgaactctgcagtctattctaagtcttttcaagtttatccattaatatacctagtgcagaaatgattctgttgatttttattctctcattcaccattatttccaaatccttaatgccagaagaggaagtccagcctggaaaaggcactggaaaatttgagggcaatctaaaaatctctgtcagtcagtaatgattcccagataattaaaacttttttttttttttaattaaggtaactttcaagggctgcattagtggttcaatgctgcgtattaacatgacaaaaacctctattacctttagataatgaggtggtgtgttaagtaaccttagtacaatgatatgcatacagaatgtacaaaattttcaattaattcaattatttaattagtttagcttatggttaaaaagatacttttttttctgttgttggaggtcttattagaattcttcatatatatatatatacacacacacacacacacacacacacatatatgtacacatacacacatatatatatatgtatattttgttctttcctgcctaagggtggtttattgacagtctttaattcttccctagatatctggaatactgcattgcatctgagtcatgctctgtgtagactatttgtcactgggccacagtgctgctgcaaaaggtggctgaggaatgcacactggctccagcagtatcctgtaagatttagctcttttaaataaaggaattcttaggagcagttagttttcattgcctcttgcactaaaagcaaggcctgacaacattagctatccaaaagttccagttaatgaaggtttcattgtaaaaaagaatccatttgggggaaggtgcaaactctttgtaattttctctccctctttctcttggcctaggccagccatggttcacaaagctggagaatggagaatcattagctgctgatggtgctggtcatcccaccctggcaaggaaaggaacaggtatgttgagtgaccaggttgacctgtgcagtggatgagccgaaaacctcttttgtaagctgttttgtaaagatatggagacaactgatgattctggaggtggaggatgctttgagggccagaacacacactctgcaataaagcaggtcacttccttcaggttttaagctaaaatgtgaacacatcagtggactttcacataagctgtgctttctttctggaatgtctccttttcctcttctccatctagtgaacctctactcatcttctactctttcgagttaaatactacttttgaacaaataatagcaaaagaacaattaacggcaacagaactttggaatgacagttatcaaactagtcctgatccataaacaaaagtctacttagcacattgtgtgaaaaaatgaagtctctttgtttttattttcttaaaccactttattccagtatgactgacatgtaaaaggttgtacgtatttaatgcatacaacttgatcaatttagggataagtacatacacatcaaaccatcaccaccatcaagactataagcatacccatcagctcccaaattttcctccagctcctttcattattattatcatcatttttgtgtgtgtggtaagaatacttaacataagatctcctcttctggcaaattttaaatacacaatacactattgttagttactggaactatgctacagtagatctctagagcttatttctcttgcataagtaaaattttctatttaaccatcacctttccatttctgcccccagcccctggtaaccaccattctactgcctgcttttacgggtttagctatattagattccacattgaagtgagatcatatagtatttgctttctgtgcctggcttatttcacttagcataatgtccttcaggttcatccatattgttgcaaatggcaggatttccttctttttcatggccaaataatattccatggtatgtatacactacattttctttattcatctaatgatggaaatacagattgattccttgtcttaggacattgtgactaatgctgcaatgaacacgggagtgcaggtatctcctcaagatcttaattttttttcttcttttgagatggagtcttgctctgtcacccaggctggagtgcagtggagagatcttggctcactgcaacttctgcctcccgggttcaaacgattctcctgcttcagccttctgagcagctgggattacaggcatgcgccaccatgcctggctaattttcgtatttttagtagagagggggttttgtcatgttggtcaggctggtctcaaactcctgaccttaggtgatttgcccgcctcagcctctcaaactgctgggattacaggcttgagccactgcgcctggccaagatcctaatttaaatttgtttggataaatatccagaaacagaactgaagaatcatatggtgggtcaatttttaatacatgtttattttgtatcaggttgcaaatttgttgatcaaaattatgagttcaagatgaaaaagtgaaaagtagagcaatgctttctaagaaatagatactgaatcatcaaatggaaaagtaatatccccacttgctaatttaattcatcataatttacaagtctctaatgaaaaccaagcaacaaacaatgacttagtatttgttagaaaacagtttaatctccagttgtcactgaactcattagcaacatatgtcattcacacacagtgaggaattattaatttttcatttcaagaaaattgtcaaattaagctggatagaataacaacatacaataaaaaaattggtaatttattcttatattgccctagaatgatgatagtgtgtggcatgtcattaattaataaacataatattattcacatagtgggcccttgatatccatgaaatgtgtaattaatgatgaaaatgctatagtgttactatcacacttactgatcacatcgaagttttttccacccacacttaaattaaatctccctgaaatccctggttcaaatttcatgagattcaagtaatttgtgatttttttttttttttttgatgcggagtctcgctctgtcgcccaggctggagtacagtggcatgatctcagctcactgcaacctcctcctcccaggttcaagcaattctcctacctcagtctccagagtagctggaattataggtgcatgccaccatacctggattaatttctgtgtatgtgtggtttttttttttttgagacggagtctcgctctgttgcccaggctggagtgcaatggcgtgatcttggctcactgtgacctccgcctcccagatttaaacgattctcctgcctcagcctcccaagtagctgggattataggcgcctgccaccacccctggctaatttttgtatttttagtagagatggggtttcaccatgttggccaggctggtctcaaactcctgacctcaagtgatctgctcacctcggcctccccaaatgctgggattacaggcatgagccactgcgcctggcctgatttgcgatttttcatgaagaattttttaaaggccaaagttcatcctcaagataagaaaaatgattgtttgccatagaattcttctaatctcaacttttaaaagaatttattaacatttcaggtcaaatgcctcaaatgttgaaatctcatattttaattctttgagatgaagtgttttccccagcatttcttttttttttttatttagatttagtcttaactcgcatcaaggtttataaaaaatgatatttctatttcatgagcatggacagaatgtgttgaagcctccctgcaggaaaattatgagcagaggtaaaaatccttgcagcattcttagctccttagctgtagtgtctcttagagaaatgttgcatataaggaatgctaattaaggaggctgggagaaaagagatgccacctttccaaacacaacatttcaaaaacaagtattactaacatggtggttttatgaagcacttgaatcttacataagtatggcttgttttttgtttcctaaaaaaagactgcatttgagcaaaccaaaacccgagtaatttaaatcatgaatttcagagaaaaaagttttgcatctagctaggaacttaataaaatataagttttcaaatactttttttttctattttaaaatcaggtacactgctatttgcaaaatctctagtcaagtagaagcagaaaaagaccgtcttaattttaaaagagtaaccctgctcccatttatgaggatttttgcagggagaaagattttataagatattcacttcaatacaaaagggcttaaattcaagagtatttaaactttgaatttcaacttatcccttggaatggcctcatggctaatttcttgtctatatacaaggtcaaatagatgtatgtctttggttaatttggactgactgccaagcaatttattaggaagctggaggatctaaattgatcatgaagacaacagaataaatgggctttgtctgattacttccgtttacctgatgattaaatcctgcctgcagaaaatttatgtgacttccaaataacacagagacagacagacaaccccatgacacactatttaaaactcttatcttcattaaatgaaaaaaaatcaatttcaaaagtaccttttgttctttatgtctttgttaaattacgtctgaggaagtaaaagagcttcttgttgccgtacttcctggtctattgtcatatatcccacaattggagactttttgcaagatgggtaatttggatatcaaatatgagaaattataagtgcctttagcagatactgcttttccaagagttcagtgtgatcttggataaaaatttgggcagatggcttcctttggaggcttatacattgttttccacaaaatgtagttgatggagaccagagaagcattgcattttttttttttttttttttttttttgagacggagtctcactctgtcgcccaggccagagtgcagtggcgtgatctcggctcactgcaacctctgcctcctgggttcacgccattctcctgcctcagccttctgagtagctgggactactggcacacgccgccacgctcagctaattttttgtatttttagtagaggcagggtttcactgtgttagccaggatggtctcgatctcctgacctcgtgatccgcccgcctcagcctcccgaagtgctgggattacaggcgtgagccaccgcacccggcccagagaggcaatttttaagatggaaaaaaaaaaaaagattctctccaactctctttgcccagcctgccaatgctcccattttcacagcacccaggccagccaagacctaaccttatgcagaaaaaggaacaatgctttaactaggcacagagttctattacttttgctacctaatatgcaaaacactaaaggaagagggcttattaaagaaccgcagcatgttttgtaaaagttggtcactgagtctttgacagaactgctacagtactacagttctaagttcctactggcagcttctattttgagagtcatgccttgatgggagctacaaacaatgcagcccacagtagtacacattcatccatccattcattccttcagcaaatacacattgagggtggaatgtgatggctgatgttaagttggttaggagcacacaaaaatgcacaggacatacttattgctttgagaagctctgggcctagtggggaagatgaagtgacagatgctcttagggagtaggttcagagtggtgtgaaaagtagggagtggcaatctctacctggggagctggggatggcctcacggaatagaagacaggcttcagggctgagaaggagatttccaagtaaagagctataggaaggcgattctacacagaggagacaccgtgtgcagtctcagacgtgtgcaaggacacaacaggacatgtctgtttatggtttcaaaattttacttagttccctattaattttgctaagggggaaccatatgtgtgagtagcaggactgggggatatgaaggtgggtcagagccagattgttaagagccttcaaaaggaatttggtcttcaacttaaacaaattagaaaatacgtgtaaagtgcttggaaagatgtccagcatatagtgtatactcggtaaatacaagctgtttctgttatgttgaagtagacaggaaaccaaccaaggttttaaagaagggaaaggatgctcatgactataatcccagcactttgggaggctgaggtgggtggatcacgaggtcaagagatcgagagcatcctggccaacccagtgaaaccccatctctactaaaaatacaaaaattagctgggcatggtggtgcacgcctgtagtcccacctacccaggaggctgaagcagcagaattgcttgaacccaggaggtggaggttgcagtgagccaagattgtgccattgcactccagcctggtgacagagcgagactccatctcaaaaaaaaaaaaaaaaaaaaaaaaaaaaggagggaaaggatgatgatggcagagttggtttataacaataattctgatgccaatattgagaatgggctgcagtggggaggcactgtccacaggccaggaaagggaaataattcaaatagtgaggataaggctcagcaattagaacttgttcattactaaattcccagggtccaacatagtggctacttgcagtgggtgctcaatgaatagttgctgaatgaataaatgaatggcaatgggaggagggagcagatctgagaaatctctaggcggcagaaacagcagggttggtgagtaccagatgtaggcgttaaaggagagggaggtttttttaaggatgactctggaaattaggcttgggaagatggtgttgccaaattctgcaatcaagtagaaaggaggaagaacagggttggcagggaacatgaggctctgggagtactactttctatgcatctgctgggtttagcctcttggagtgttgagaaaaagtgggcaagggaggacaaagaaccctcacatgggcactgagctgggtgttttcctttttactgtgtttaatccccacggactatgagtttgatattgttatccctgtttacaggtggggaaactggggctcaagatgacacattagcgaggtggcagagcccacattaaaaacacgtatctttctgccacaaagcctgagctttttccccccctccatccatcaaattgcctcctccattaaaatgaacatttggaatatgatatattccatatttagaaggctcgggggtgcagggtgagtactttgcaaaggaaccaaagcctaacttctgttaactttctgcttcatcgatactccaaatctgtcttcctcattcacagagtccctatgaggatccaaaaagatgtgagaaatcttttgaaaaatataaagcgttctataaaaacaaggtgatatcaaaaatgagaagaaaaatatgttcagattcttgttaaggaattctagaacactgtaaaagatgacagaagctggatactgtcttaggaccatttgactggcaacagcctctttccaactatggttcagggagcaggttgaggtttttctgtctttaggggtcagtcttcctaaaatatgaaaacccgggtttgaggtatggggaaagaatgaattttgccttccaaaggcagagtttacaacttgacggctttcactcctctttcaaaaataaacctaaattcctatcagttgtctgcagagttccatcagggacttggtagagtggcccctaactggggagcaggaattatatgtgcttcctccttgttctgcaaagcctctgaacaccaccgagggcccatggagagcgtgatgatgtgtctcttggcccatcacaacgtaagcatgctgagcagaggctctatcccacatcctcactgtagccacagtgtccagcaggaaggggctcactgtatgtaactacaagaactttcggtgtttgcattcttccctttgctctttaaatggctggcttcttcttcccactcagttttcagcttaggtgccacgctgggagaggcctcctgtgactgccctagttaaatagatcccccctgctactctctatcactgcactctgtcatttttcatgtggttcctttcagaatttataatcacacatttgcttgtttggttatctgtgcctccctctcaaaccagactgtaggcttgagggcacaaagcatgtcaactctattcagcccagcatctagcatggggctggcatgtggtaggcattcagggtctaactgttgttttaatgaacaaacagacctaaacctgagatggtgggacaaccgacaggaaagcagaaggccccctcagcactcgggggctgttgttccataatcaggcttcattatgatctgggaccagggatggagccgtggattggctcacatgtggactgggcccacccctctggactcatcagcaagacatgcaaaccacatgagtcaatggtccacacacagccccaaaggagaagaacacaagtatcactattcctcaactttggagtaggttccttggtctcctagttaaatatgcatggcacataaaaataattgtgcagacagaaggactcacagttgcttaatgtagaccaggaaagtgtttgaaccattcagtgggtggtgcgactcctaggggaaaccagccacgggtgggaatagaaactactccaggaaatggtactgtatggaacaatttacatattttggggcatgggaagttttggaaatgcatttgttctcctccatatctaccactgaaataaatccttgagatttaaaatgagtagatgatatttagtaatatgactgaaaaatcacataggactcatttatgagccaggctttatgcgcaatttacaacctgtatggaaagcaacaccatcccctgttttacaaagaaggaaacaagttcagggaggttatgcaagtctgttagattttaacacttgcactcccttcaccatggagccaaagcctagacttaattgtttagaatatcattctaaattgctttttgcaatgtcatttcttatgcatttcttacacaccttttaggtgccaggaacgtatttctaaaggcaggatagcattgcagaaatgctagcctccaagagatggggtgtattttccattgagaagcagaattaggggaagggtagttttacctcctcagtgtcaactgaaatggcagtcattcaacatttcactcatttcccatcagacaattttaatctgaataaagtttttaaaaatctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaatctcttaagaaaccatctccttacaaattcccttcttgcaaaatacttatttttcagtaaatatcttcgttgacaattctaacaaaggtactcaaattctatatcctggctatgcctgtcaagagagttgaaggaggcagtggccatatttagagggccaaaacctgttcttctggtggtatattttgctgatctgctgatcttgaaggactccagtgccttaaatttacccacatgtcatttattgctgcctaatgtgcttattcattattttttgaaaatagaagcatattcggaaacatatttaattttacgatgttaaaaatgatcacttctggttcttcaccagaactatatggagtacctggaatacagtaggtactcagtaagtacactattaataaatgaagaaaatatacgcaggataaaataaactgtttttcataattctatccatatatgatttttaggattgtactggcttaaaagctgggactatacaaatacatcatcaatgtgaaaagctgggaaaatgggaatgcgaaaatcaaactggctcttggccagtgattttttttaaaaaaacaaggtcttcaaatgtttgtaaactgcaaaatgtccttgttgtccttctccctttttttttactactggcattgtcatacaaactttgtgtctcttccaaattagtctgttgtttgggatccttaactacggagagtgtcaactgtgcgtctccaagacaaacaggttgatgcgctgtctttctcagacctatgctttaaagcccaggctagggtcatgctctgagactagagcattctgactttctctggtctgctcttttctggtccttgattttcttatctgaatcatggggtgtccattgtttagacggaaggttgcaaatataaattaaataattcctcagcaaacaatatctttctgtgaggtgcatatatcagtggctaggaaaatatctgaggcctgctacatcatggtttagtgaataatttgcattttatgatgtatatacagtgtagctatgaataatctgccagaaattatagctatacatatataagccatacactcactaatggtaacccattctccttatttttgaacccattctcggtaccagtaatagagagctcactggctttgatttgaggcagacctaggtttgaatcctagctctaatatgtacaggttgaatctcagggaaagaattcatctttctcagctttagtttcttcatctgtgaaatggagataataccaacttcataggcctattgaaggcatttaatgtgttgattatatgcatgaagactgatttgttaacaaacagatgatttcatgtgtgtgtgcatgagttgggtgcagccttaataagtgttccccttctcttctgttttgctatttaatgtgatggtgaggagagtggtcagtgtttgtctgtctcttccttctagaagttagggtggcataagatgaggatatgggggacagcagcctcagggagatactgaataacctctgggagcctaggaggacagatgcttgacactagctggggacaaaaaaggaagagcccaaacagtttttaaagcagaatcttctgtgtctagaagaatcaataggaaggtgcatcatcaaaagaactagagaacacaaatgacagggtatgacatgagtgttcactttcattaagtaaacactgctggggtttacttaatacctggtgagagggaaaaaaagcagtattactccacaaacatttgttaaaatatcaactatgtgagcaagccatacaatggagaggcaatgattcctaagacataacccctgcacacaatgattcctgacataacccctgcacacagtgagttcttagtcacaggggaagcacacacagacacaagagggctgtgattaatcctatatgaaaggacaacatgccatggagcacagaggaggaagtagttacttctaagaagaccaaagacattttcaaagaggtgaggatattttaagcgaggtcttagaggacgctgttcacagggaagaggagatgtaaaagcattctaggccaatgcacctgcatgagaggagtgggatacggtgtgagcaatgcttggagaattgcagctatttggatactgctgggacataatgacctcggcagccaggaattgtggttacattgcagggggccttgaggctagagagagagaactgattgagcttgaggagggagagtgggaagggacccagagcacagatggagttattggctttggagataaaaagggacacatgtttctctgagtaggtgagtctgggtgttacttggataagtctagagaagaagagacagtacgttctaacagaacatgccttgttaccttcatgctctcggtgtagtgggaggcaatgtcactggttgaataaatatgaataaatgaatgaatgaataaatgaatgaaggtggctagggtagaggattaagaagcattaaaatgaatatttcaagaactatttatgggggtcagtaaatataatatttctaaactcaaaacttctaaactcaaggtatttataagctagttgaagatgtaaagacatcatacatcttttcaaagcacaggaagttaaatgaatggttcctaaaatatgaatgttcagagggaaaagtacgtttattaactgcttgacaaagaagtatgtagctatattttgtgtaacacactatggtgtagtcttatctttttgggtatgtttttctttcttaatgttaaaatatttcatagctggtccatgtaactatagttatacttttagttttactcaggttcccgataatgtttgtcgcacagacaggtttgtgtactggttttaataattccattgtactttctacctcctcctccgcccccatccccagggtcttcaggtcacagttgggacctactctatgtactctggtgctctccataagcaaatgggatgatttctctgaaaagacagctctagattatagtcctgaaaaagagagctcttgagtcaatgaaaaaatcatagtttagagtagaagagaaaggtaagtatgttcagaggaaaagctggtcagatgaatgtaagagaggcttcttttatttgttcatttaattttgagacagtgtcttgctctgtcagccaggcttcagcgaagtgctgagatcatggctcactgttgccttgacctcctgggctcagccattctcccacctctgcctcccgagtagctaggaccacaggcccatgctaccatgcctggctgtttgtattttttgtagagatggggtttcgtcatgttgcccaggctggtcttgaattcctgggctcaagtgatccgctcgcctcagcttcccaaagtgttgggactacaggagtgagccaccatgcccagtctcaagaggaaattcttttagcagagctttgagagataggtatggaagaacaggctggggttagagtatatgttgctaaggaatctgaccctcactccatgggcaataaggagccatggagcagggatagaacacttctctggcactactggaagctgtgatgtccaatgtatgctctctggaagatctaactaaacacaaccttagcacttctctcaattttctttgaaaaggcaaatcttgtgagtcatttgttctctgtaaaatgagagaggaacatacattatcaccttatattatcgatttacattaagaagacttccggattctcttagggttgttgtgtctttctaagatttcaggcaggtgggtaaatccttattttcatggattttctattggctaaaggaacgctgtgtgtagtttgttggaatatactttgtagaagacattcttgcccttgtgaaccagtttgattcccgaatcacacaagtgctgggttccagaagagattttggatataacgccaggatttctgaccctacagctaagaataggcagcaataggaactcaagttacaaaaaatgacttcaatagagcattcacatatgtgatggtatcagagcccaagtcttcaaagagaaatattttgaaacttctccctggtttctggcaagagcagcaaatcttgatttttcaggcctttataaaaataagaaaagactaacaattttaaacctgggcattaatcaaccatttaatgatgccaacaaatgagttttactgtaattcagtgcggggagattaaaggaaacctaagagccacaaataagccattatgaacagtttacagtgattgagtacataagctgtgattaataatgatcagaagtaaatctatgaataacaacaaacagaaaggacttgttagattgagaattttatcagaaaggtataatttggatgttgactcagtggtaacaacaggaaaaataaattacctttatgcattttagtttatgaaaatcaaatagataatatatgaaacaacatttaaatcgatacagcccaggagatataaaagtataggtttgtgtggtcttctaattaactgacatttacacatttttcttaagatcactgtaagcaaaatgggaaagctctctaaatttttggccttttgggagggaggcttttcagtcttgctcatatttgagtcaatacactgatgtcttgacttgcgaaaaaattttcacatccctgttttgggctctcatattttctttattacacaggaaaaaaactttattgcacagacaaacagaagttaaattgaattgattttataagctgcaataagtacagctcccagaaacaaatgcaaatggaatgaacagttcttaccatatgtttcacataggctactcacgttttctctcgttccgagatgatttcaaaaaacctgttctgttaatgtatgtatgaaattctgcaatcttaaagatttaaaaacctatatgttttcaaagacctgaatatcctgatacacatcctttcacacctggatgccaaacacatacactgaaatatattctatgaacaaaggaatttgaaagggaccacaaatttcgcattgcatgctgaagctgtcctgtgtcagctcttcaaactggggcctctgaattttaggaaaaagtgctattattctggttcagtaagtttgaccctttgttgtctatctctgctccttagagacacaagcaggccttgtgcttactaagtgaatattaatatcttcattaaaccttgatagacaagcacactacagccctcatccaaaatatgcacaaaattagaaggcaaaaataaaaaaagagccagacattataagcccgtcaatggaagcagagagccacaccattaatggtggattgaaaaagactctgtgttgttcacctcccacgtataaatgagaacacacggtgtttggttttctgttactgtgttagtttgctgaggatactggtttccagctccatccatggacacagggaggggaacaacacacactggggcctgtcaggggtcagggggagggagagcatcaggataaacagctaatgcatgttgggcttaataactaggtgacaggttgacaggtgcagcaaaccaacatggcacacgtttacctatgtaacaaatctgcaagtccggtacgggtatcctggaacttaaactaaaattaaaaaaaagaaaaagacttcctcagttttttctctaatggcctgaagcaaaaattactctcatttcctcttcattgatataatttgtttttgagaggtgaggggacaatgggaagagagtggttttaagtcactataaaaagattattgacagatgcgtggtaaaatgaaagactcaaaaattcctgaccctttctcccctccagagttaggtaggcgggaaggaccccaaacttccatacaagagtctcttaaggtaaaattaagacagcttccccttcggagtttatgctagtatttcataattttccagccaagagctggaaattatgaaatagttgcataaactctgttaatatagatggatcaggctccaatcttgattttgccatttctcatatcatttttctagggctgagggggcgcacttcttggagtccagtttctgatataaagagaaaagccatttagtgtcttggaaaaaaacaaaagaaggaaggaagggtgttgttgatttaatagatcacccttattgttctaatggctccagatggctctcctactgtgtggatgagatttgacagtgccttcttggggagaaacagaagacttcactagcttcgctcagcaaatgaccactgattgcctggaatggaggagttaatgtgatcaattaacaatgtttgaagaaaaatgatgtttgccagctgttgatttcatcagcaagaaaaagcccacaataatcatcttagaaaagaacttaattagttttgatcctaagatagcatgcaaaagttctggactaatttctagtctgaagatattcataacatattagagctggcatgaactctggtgattactagaaaaaaagatttttaagtttgtgaaaacagagatgtgctcaaggtcacccacagttaacagaaaaactggggctgaatcctggggcttctgagctctgatatgctgctttttcccaccacaaatcacagtttttgagattcacactttgaaaagaatgatccaaagtaacactgccattttggggtgagtgttctcttatgacagatgagtttttttttaccttcctgtttccatatgtttaaaatgctattagtatttcaaacctcattttctttctttttaaaaattcagccatgattttagagtgacagatttgccatatcaatttctaaaggtaagtgtttgggtcagtttgctttttctctaaattgtgtttgtcatccctcagtgtagtaagattttggtgtggttatgctgacattaaagtttccttttcttaaaataaaactaatgacttgaccttgatattgtataagagtacaggccctagggtcagtcatcctgggttcagaacccagcctaccacttctcagccatgtattgcgggagagttatttatggttccctacatttcagttctctcatctataaaatgggaacagtaataatcccattctcaaagggttgtttgtgtgagaattaaatgagctgatctatgcaaagtacttacacagtgactggaacatagtgaacactcaatgtagctaacagttattattattattactagaaaaaaattgaaaaataattttatgtaattgttacttacatgagtagcggggtctcagcttcccaacacaccatgagaatatgaaatttcatcaataaattcaaatagacactttatgtaaaaccctttgctcaaataatgtaacttagcaatgactgacttttagatactggggaaatgcattcatatgaaccagtgcgacattctgaaaactggttcattgaatcccaataatataggttcttactctcaagtaggaatcaataatgcacatcccctctgtacccacatgccccataaaaaagctgttcaggacaatcttgctttatatattatacacattcagggcacatttagagttctgaaatttgaggtgcaaagtaagcattttgatagggatatttttccaaagaatgtttttggccccagcataaaatgaaaaatctctaccacagacagttgcatttcatggtccaatatagtctctgcatgaaaaccaacagatcattctacatgtctcctgacacatttacaacaggcactctgtgtaaaacccattcgcatcactgggggttctcaccaattcttaggcccttgacttatttgtgactgggatacctttatcacaaagacatgctttacagatattttcacggacacaagctattccagtcttgtcctgcataattaagtttttacattcagtaagtagagttcacctcttcctcctaatggtaagtgtttattaaccataatgactaataaagaggttctggcctccgtcacctgagaagaacaaaacagtggggtttttctgcagctcggctggatcccagcttctatgacctctgctgctaacaggctctccacaggcaatgaatgggagacgccagctatgcaaattagagtactgatgttccttgtcagctgcaaagcccaaatggccctgaaggtgacccaagtgaggcttctgtgctgtgtgcctggttaggtggagaccctgattagtctgattatggcaacaaattttttaattgctttatggggtgcatgaaaattatatgtttatctccttttattgaataaagtgtgttggttgtatatgttcaatgttggtagggaggaaggtattcttatatataaagagaaaatctgttactctttatgtcagatcagttgatagatattaaacaaatcatgttgttttctcatattgagtatagatcactaatgaccagctggaacagaagtaaacttgtacattagccagtaatgaacaaaatgctaaagatataactagagaaattctagaggtaaggaaatagtccacatatattaatacattttttcccacagtcatcttggtagaaagttgaccgtgatgtcgatgatataactgggtcagacaaataccttttaatagtctgtattacttacacacgcatacgtggcaacagatttaccttagacataaacacgagtttatattcctggaggtgtcctagaagcatgctgactgttgtgtcctcagtattattcacttcaataaccgtaagagctggcgttctctccaagactctgttccttgaaggaaggaactatctactgttcccctagtaagacctggcctacaataggtgtctgtgatgctttttttttttttcatttttaaatgtccattttgtttattgatacataatatttgtgcatacttatggtacgtgtgatattttgatacatgtatagaatttgtaacaatcaagtttagaatatccatcacctcaaacatttatcatttctctgtgttgagaacatttcaagtcttctcctctagctattttgaaatatacaatatactgttgttaactacacagtagtcaccctactgggctaagggatggttaatgtgtctactcagctagatcacagtgcccagatatgtgatcaaacattattccagatgtttctgtgaggatgtttttggatgagactgctgttcacactggtagattttgagtgaagtagattactcttcctaatgtgggtgggcctcatccaatcaggtgaaggcctgagtagaacaaaggactgacctcccgcaagcaggagggaactctgccagcaggcagcctttgggatcaaactgcagattctggacttgccagcctccataactgcatgggccaattccttaaaacatacctttctatgtatgtatacttacatcctagtggttctgtttctctggagaaccctaatactgtgtccagtaaaaatctgttgtctgatgaaggaaagataattgcctgcctctttccatcccttcaacactcaccctgactctcagaacacacgctgtttggcctcatcctaatctccattccctcagtttctctgttacatccctgccatttatcccatttatgatatccctccttccttaggcaggataaacttgaagatactgttttcatcttcagcatactacctcctttgtctttcctctgctcgccttgtaaatcttcaacatctaatcaaatcatgtgccttctctaacctcactgttgttttctgctggagagaagccctgccaccagccagtacatattcataatggttgactgtatgtggctgggccctcagaccgctcagaacaccttttcatggtccttagtcagcccctactctctaccaccccaaatctttcttgctattcctctggtctcccatttctatcttcagactctcgatcttattgcctgacaaatgtttcaagcagaactcatcaccttccccacttcttgttcctcttgcttagtccctgttgtgataaattatgtccctcccctccccattcatctgcccaagctggaagaaaatttggcatcatccatgcctcttctttcatcttcaattccatcacccatccagttatttaacaagcgttagctgagtggctattatgttcctggcattattctagagcttgggatataagagtggacaaagtaaaacaaaaacactcctgccctcatggagcttatattctagcaggggagaaggatcatgaacataagaataattaaatttacagagtatattagaaagtgaataaacgagacagggaaaaatagagcatgaaaagggtgataagaatcgacgtgtgtgttggtggggaggtggagtgtgcagtgttaaacatggtggtcaggatatgcttcaatgagaagatggcactggagccaagacttgaggtgagggagggactcacacagatatctggggacaaatcactttgggtcaaggcaatagctggtatagagggcctgtcttaatccatttgggctgctataacaaaatgccattggctgggtagcttcaaaacaacaaaaatttatttctcacagttctggaggctgggaagtccaagatcaagatgctggcagattcggtatctggtgagggcatgcttcctaatagatggccgtcttctcactgtaacctcacgtgcaagtgttagaaaagttgggggagcctgagggtgtctctaggttgttgttgttcttgttaaggtactaagcccctcccaaaggccccacctcctaataccatcactttaggagttaggatttcaatatataaattctggggagacacaaacgttcatatctaaagcaaggccctaaagagggcctttttgagcgaagtaggccctaaagcaagagtgtccctggcatgttgctcgagcagtcacagcacttctgcgaatcttcagttacagcactcctgtgaatctccaactgtccatctcactgctactacctcaatctaggctctgggccttctcacctaaattaatatactgatttcctaagtggttttcttatatctggtcttgctgcatgcccacctacttcccacaccgagctagaatgacctttcaaaaacacagatgtcacctcatcagaattcttccatggctccccactgcccacaggctgacatgtgcacattgggagggcttagccctctcccacctggctccagcccactgctgcaatatcacaatatcacctcgcccatccttgacgcttatccagaggtctgtacataagattctctaaatgcaccaagttccctctggacccttcacctttgggacactgcttcctcctcataaaacacctatctcttttgctacccattgcaaccctcctcgtgctagaaagcatggcctggtcagctcagtctcatttccctttccctatacaacattgcttcctgcagaaagttcctcctgcccttcctctctctggcttaggtaccctccactatgcttccacaagagtgtggctatctctactgcagcaatttcatactgtatcttcacagtctctttattttttgggctcccctagtaggttttgaatatgggcaaggatcatgctttttaaatatcccagcacttggagccttacttgatacataaggagatactacataagttttggtcaaatgaataaacaaatacacaaataagccccatgtggaaaggtgaggattatatagatgcataaatagggaaaaactatatgcagaaactgtacatagcttcctctaaaaaggaatttcttatggaagcagaatctgtaaccatgaggcagccacccagaggagtagagtaatgatttgtgctgctccagtgactatgggttaggatgagtttccaggtcaactggattactctgatccctctttagagccattgcaagaaatcacatctcaaggaaagactcttctggcacctaatctcttttgtactttagtccagacagtgcgaggccatcttcaaataaaacaatctctttggcttcacagacaagaaaaatgtaatctatttcctacacgtgacaacaagagaaaatctaaaatggcacaaaaatgtaatggtaatatcctacagagaggaaagagctgaatcaaaatgaaatatgaccaaatgcaatcagcagctaacagcaggaaaaaggcagctgtcatcttcatttctttcataaacttcttagaacaaattatgtcttttagaatgtaagtcagtttgtcgggcgcagtggctcacgcctgtagtcccagcactttgggaggctgaggcgggcagatcacgagatcaggagatcaagaccatcctggcttcatcctggtgaaaccccgtctctactaaaaatacagaaaattagtggggtgtggtggcgggcacctgtagtcccagctacttgggaggctgaggcaggagaatggtgtggacccgggaggaggagcttgcagtgagccgagatcgcaccactacgctccagcctggcaacagagcaagactccatctcaaaaaaaaaaaaaaagaatataagtcagttttctttctggatactacttcgtaaagcttctgccgtttatgggaggtaaagcattctctgcatcacccaacttcgaagctggcctgcatttgcttagacatttcattcatgaaagcctgccctctcttagcagaggagcgatctaaacaccacagtcccaaacacctccatctgactgtctcctctgtttgtctatcaaaccactgattaaaacacattctgcattgattgattaataaacaggtttcagcagctctggacactcagagtctagaaggagaaaagtctagactcaaatagataaaaacccgtaattcaaggcagaacacaccctgggcccgagggggctggaggagaggtgccaagtgtgggctgcgcatggaacgggaacactggtgttaggtgtgggctgcttggaacgtcccaggagtagcttgcctcatgttgcagactaggaatccagctgtctggaggtggaagaatccatggatggtgcatattgcagagacacggtttcaaaatcttttgcaggatgcacatgttagaaaagagatcttaaaaaataaaaaatcctctaatggctttaaatgagcatgaagcattcagatgttaatgtttagctgtgtagacaaggtgtttcccaagttatctcaaaggttgatgacatgacgaattgccccctttaaagaaaataccaaatacacgaacaacaaacttccccgaatgtgttgactatcttttggaatgaagagaaaatctgggtcgagttgaaatcaccaaaagtcaatccacaaagtggaatgacattgctaacacacttagcatgagacctgaccccatctgattattgctcagcaaatgggggctgtcctgattgattactatttgtccagtctctcaccagctgagctctttcctctgttcctaaaataaagggtagggtgggggactttgtgccagataactaatctttactcagtaccttttctgtttcaggcattctgttagcagcttgatgtactgttctcatctatctcctcaagagtcctttgagagatatattttataactgttttgtagaaaaaaaccacgaaggatctggagatgttaggtgtatccaagggcacaagatgattgggaaggagtgaagatatggatgccagagcctgaaaacactccatgtgtcccatggtagcttgttctttggccaagtagcccttgcacacccccgccttgtcttgagacatgtcaccaaagacactcaaaccataagctccatgaggaaggaattttttattttcaccattaattataccccagttccttccacagtgcttgatgcatgcttggtattcaatacatatttattaagaagtgaatagacccaaggcctgggatgaagtttctgtctccaccaccactttccacccattcaagagtgagctgctcccctacgaggactgggcacgagtcaaaacactcctgggaaggatgaagtcttttggggagttcaagaactcctgagtccggacaagacttgtgccaacctgggtgacaaaggaactgtgagaccctggatggagttacaacccgaagatatgcctgaggcctgtcattcagcacttaattcctttttctggtgaaaattaaagtaactaaaatcctggaaccctagaggcttccagaattgtaacaactgtcttcagtagccatcaatctaattacatttttgcaatattctcattttgagctacaaaggtacaaattacacaaaattgtgtgtggaatgcatacatatgtatgtgtgtgtatgtgtgtatatatatgtatatatataaacgttaacatttagatgttaatgtttagccatgtagacaaggtatttcccaaattatctcaaaggttaatgacataattgtcccctttaaaaaaatactgaaaacatgaaaaacaaacttccctgaatgtgagcctcactttgttctgtacaatggagataataaaaccttctgtttcacatgaagagtacatgatggaatatggcaaaatgtcctgaaaaccagaaagtagtcttgtcaatagccaagatctgcctgactttttcacttggggtgcagtagttaagagggaatgtgctggagcccagctctggcatggccactagcaggtttgggagagcctgtgcttcagttgctttacctgtaacagggagatggaaatgtacccagctcctggaattgtttgaaagattcaatgtgaattcaatgatataacacatctaaagcacttagaagagcccagcacatgaacaatgcttaaacaaatgtttgctgtgattattactgtgctttcgggatcactgtgcaaatgacgattctggtcagctatgcattcccagagcagtggaagggttcactagcagctatcttcagtaatacactgcagtgaggggtagtcagatccaggcccacaatccaataaaggtggttggtcccagaagttattttgccagataggcagaaatcaaattgaagagaagagctttggggagcatgtgttctttacttccttttcctccctccctcacccttttcttttctttgctatttaaataaaccaccactttcaggcctgcctgggagaagatattagggcagcagggagtccagctgggagatgatgaggaaagcagctgagcccctgctattccacctcatccactccatcctccccaattaactggtaacgaggtggtgacgccctaaccacatttcacttcctgctaacaaagcttgtacaacaaatgcaaacacttggctgtcagcttctgtccagcacacagcctcgttatccatctcacccttctgcatctatgtcagcatccaggaggcaggcccaggacgacaaaccttctttgtgctacactcaatgccgtaccaggctctgatggtgcttacaaaatgcctttgcccgacagtaacaagaaaggtcccttatagatgattttgtaagaggagacatattctgtgcaggcttgtgtcattcctctgattattcagactgggagtaggggcagggaaggtgccaccatttcatttcttcctttctcatctgataaaaatttcttcccacctctttgaattgaggtcaggtctttttcccttttctaaatttgcctcaaagaagtctttttcatttttccttaagaatgactttaatggtctacattttaacctcttcctcatgtaatgtaagtgatctgcaaactttcttatatcttattccttttgaatttcaaattcctttttttctaaatcaatcccattatggcaagacattattactttctgctcacataaatactatcatccataattttctctcttccctcataaagcatgatttatgttgatatttaaaagtaaattctgatatttagtctaagtactgtcttacatattaattcaataacataatttctacgatagaaaagtacataagagtacaaaatatgaaataagcttgatatagacatagttatctgcatttgaccagtgaggaaacaaaagctcagaaaaattagataccttgcacaaatcacaaagaaatcagtggttcagctgaaaattagaaccaacatcttctgatgattacacaacttttctggttgactaccaaagaagatactagaaaaattactaatgagtgaaaataaaaagacatttcaaagtctttcatatttaacacaaaattatttttccatagaagatattcaagaagcagttacacatttgaggagctgtttttttttaattaaaaaaaccatattctttatctacatctagataatgtagattgatgatccatctaaatcaagaatttatcttctacagtgggaacaaattactggaatttaagcaacgtgaaatctcatcactttagcaatgacaatgaatgtgatgtagctttcaatgcagtactgaaaaagcttgtacactgtcacatgtcccaggcccttaggaacaaagtttagtatgcaatgagtgacgagctctataatattttcattcgaaacagagctacacaggaaatctaggatgtttataataatatttggaatatttggtataaatgtaaaacattgtaatagttttctgggcagataagagctcatcatatatccttttagttaagtcaagtgactctggagtccagttataccattagttcaaacactaccaaagactaaatacaagctcttacaggctgaattgcatctccccaaattcatatgttgaagccctaattcccaatacctatgaatgagactgtagttgaagacagggctttaaaagagctaattaatggctgggcatggtagctcacgcttgtaagcccagcactttgggaggccgaggagggcagattgcttgaggtcaggagtttgagaccagcctgggcaatacagtgaaaccctgtctctactaaaaatacaaaaattagctgggcatggtggcgtgtgcctgtaatctcagctactcgggacgctaaggcaggagaatcacttgagtccacgagttggaggttgcagtgagctgagattgtgccgctgcactccagtctgggtaacagagctagaacctatctcaaaaaaataaaaaagagagctaattaagttaacatgggggcattagggtaagccctaatcccataaaactggtgtcctattgagattaaaacacagacattacagagggttgaccttgtgagggtaaagtgaaaagggggccatcgccaagctaaggagagaggtctcagaagagacaaccgtgctgataccttgatcagctgacaccttgctgataccttgatcagggttctggaggcaggacttccagcctccagaactgtgagacaataaattacttctgttttagtcactgtggtactttgttatggaagccctagcaaaactaatgcacttaacaaacttaacacctactttcttcctccagcctctgtgcctgtgtttcatgccaacttttagtttctccttgatctgccagtaatacaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatcttgtgaatgatttgtgctgctccagtcactattaggatgagtttccaggtcaacctcctgttttgaaaggagggacttacctttgtggtcatgtatttgacacctaagacttactcgttaagtgtttgttgaatgaatgaatgaaataaaatgatctccattcctattcaaataagcctgtaaataacagtttaagcatggtcatatttgtttgttgagaaagagaagtattaagtgatataaggtttaaaaaagcaataaaatctgcaaaaagaaaagtgtctattgatgaatttattaacaggaaagaaagtaatcgaggataagaagatggaaaaggtggaagaagagaccttgacaacctgaaaaggttatacccttgtgcagatgtggtggacaaatcctcacctgagaggaggaatcaaaggggcaactgctctgaaaccggccctagagcatccaacctaaaaacaatgccttcatcatgaagttccagaaccaatgattcaaaggataccccactgaaaaaagacagtcgtcgtcctagaggtaaaaatcactttacttgccaataaacagaaacatgagcaaatgggaaataagcaaaaatgaaatgatgtgtgtgctctcttccaaagggcagcaaaagcagctgagttaatgctaatggctcacatatggtgggtggggggaaaggatgttataagtcacaaaaccctggaatggagcagaggcctgtcggcaagttaggtggtgatgatggagtcaggatgacttggaaacactgtgaaaagatggcttcagataatgggccattatctgtctgcctcttttcactttgactactgtcctctataaataatgtagctggctaatctaaaacatacagaatcaataggaagccaaatatttaggtaccacaaaatgaggcaaaaaaagagcccagattttcaaacaatgcaagtgaccctgaaaattgtaacttggcaagtctgcaatattgtgagagcaataacaatctgttaacatctagagggaataaacccaaaagaaataagaagccgagctttatgaagggaaaaaaaaaatggcacgccaaatttgattgcttttctgatggaattacaggattactagtttaagggagtggagcagatgtgatatatttgaattttattagggcatttgggagaacgtctcacacaatttccttcacaaaactaagtgactttagcttgaacatgaactgaggagataataaatgaagggtaataatacgttacagtcaatctcatcgggaggaaggtgtttaagaggtgacactaaggctcctgttgtttggggtggatagaacattgattttaatgatctgtaaaaaaggaagaataagagtgacagagaggaaacatggagatttattggacaaaaagactaggaacctggttaaaaatacctgaatatagggaaaatgcaagctaacaaatatatctgtatgtttagaaaagtaaatatatttggaaaaatatttgcagaaatgcacacatgaaaggagaaaaatgagaaattaataacactgaaaagtacacaggagaagctccttgtaataaacttgaactgcaatacagatataaaataagagatcttaataacttatactgtcataacaatgacacacatagcttgccccaaagtaaattttaggttcaaaaagctaattttactcctctttgaattgtatcattataaattttaaccttcaagtttagcaataaaatgacttaaacagtttaaacaaaagtgtaacttcctataatgacagcagcatccatcgaaatactgtaccatctgtggactagaaactacccttcttcatcctagactttgccctcttattcatctccactgaatcacaaatcttagacaattctgcctccttgcctctctttgggacctatccttgctccttgttccatagatgctaatttggttccagccctcattctttcttaccagcattattaccagagcccagtattgcagtatcacatctgctctctgtgctgtcagaacaatctttctggaaagctgaccatgtaaattctccctgtttaaaaacctccagtggctccccatgccctataagacaggcctaggcatagtgttcaagcccttgaggatctggtcccttctgatctctttagctccttctctttccaactctctcctccctttccacactctggcctgaagcccttccagttctcggcagctctgttgtctgtttgcctgtctacccctccttgcttcctccttcaggatgccatgcagatgccatattttgaaggaagccttcctggtttctttctttccactcttgtttctttagtttgtttatcatgcaattttttctactctatctataaatggtgggaggcaggggctgttttaatcctctatgttgctagcctgggacacacagtaggcccgtatgtacatgctgaataaatggacccaaaccaccaatataatcagggactgtgtctactggtaaggcaggcctgggtttgtgataaaaagtgcattggttttgtgggcagcatagtggaggcagaaataacctctaaaaggactacagtgatgacacaactgacacactgctgtaacaagccagggggtaactggggtgtgcacctgttggccggtggctcttgaattcagtcttcctcattcatctggcctacaaaataccatagtttagatcagaccctgcaggaaccataacaaaaactgaaggacaggctggtctttaagtacaacttagcagagcatgacaaatgcagattgaaccaaagtgacccttcccacctacaaatatagtcatactacacctctgcttaaagtcccttcaatggcttcccattgctaggaggctgatgtctaacagcctcatgtctctcctcttcctcacactcactcatattacattaccactggttgccacaggcaccacatgtgggatgctcccatgccttcatccgtgctgtttcctgtaactgctggaagtgccctttaccctcaaccctttctcaggtttcctggtgaattcctgatcatccttgaagtcatctcaagtatgaccttctctgagaagtctcccacaacctttctaggtagagctgagcatgcctactcagtgtcgccaatgcaccttgtaatctatcaattaatgtaattgaacagattacaaagtgcattggtgtctgttacatgcttgctcctgtcccacgttatgggccttacacgtctttgtattctgggattctagcaccatacctggcccagatcaaggactcaaattatgtgttgaattgaatttgttgaattcacatgaaagacaatacttatccaaagcctgaatggctaaagtggttatctttgggtttcttttgacaataggaagcatcatcagaatggactaaaatgatcaagaatgtgcagaaggacctccataatcagtaactatagagataccaaactttttagttacataaattgaagacaagagcaattacagaagattatatttaatggccttcaggtacaggtagaaatcacatgatattttagactgctttctttaaaaatgcatcaaagcactgtgaaaagccaaaaacatccttttggaagcagcattttataccaggtatttaaatctattttcactgtgagtttattcagagtaattgtataataaagaaaagcacttggcttcaggtcactatgcatatatagctaaattatgcaattagatgacatgtaattaaccagagtagcaacacagccaatctaatggggccagttggggtctgagtgactcataaaaacattatgtagttaagcgataggcacctacaagaacaatgaattttggtctacctgcagcctaatgagtccctcctgtgactaaagaggtaatgcaaagagaggtctcagagacagggcagtgtcaatggaaattctgtctaagaaggagccaaggtatcatcttgattcttattttccaaaacttctaatgagataagaaatctctccaaacgtactgctgccaacattaccagcttgactcttccattaccacaaataataaacaaaaaacattagttaaagcttattttgaatgaacttgaagaaatacttcctgacccattactcaggtagtatatacaacagattgactattcagtaagtgaaaactaacggcggaagaaatccaaattagctttcttccttttccttcaaggatgtatacatggcaagcatgcatgaattaacacagttatgaacaagaaatattatctcttgtgtaaagatcaaggtttactgtctcattgtgtttggttttgggaacgtagttttgattttgtttgcttaagagatggaagaattccagttctgaaagaattcaagctatgaacaggaaagtatacttcaataattgtcccagtgacccttatttttattaagaagaatctagcaactgtcatacttgctaatgtggcaataattcttctaatcttaaatttttaagtaaggaaaaaatgaatatgtagccatttaatcacaaactcatcctctatttcccaacaccacttattccatatatatatttactgaatataaatatactaggcctcagtggaaacacgaaggatgtgcaagactcagtacctgcctttaaatagcttacaatctactagaggaatgaaatctgtcgcccactcttttattttcttcttcgaaatggtttgagtatatacagtatactctaaaggtttaattaaaatggaatatataaaaatctgaaaggatacatactaaaatgtaatctgaaagaggggtagcaaattattctttttgctctctacattttctaattttttttttccctaatgaggacgtactacttgtgtaaaaaggagaagaaagttattttatgaaagatgaaaaaaaaaaaaacacctcactctggttagcctgatattttgtccttttgaacacttaaaaggccccattaccaggcagaggttgcaatgagctgagatggttccactgcactccagcctgggtgacagaatgagaccctgtctcaaaacaaacaaacaaacaaacaaacaaacaaaatgccccattgcctaaactctgaaaaagtcaatacggggttgttgacaaaatctattattactgcccatctggtgatctgctgctcccctaccagtgaggaagcttcttgaggtcggggactctgtcttgtttgctattttgtttgttcaattcctaacagggatcagaggacaccatagataggtaataaacgtgtggggaagatgggaggacaggagagcaggaagagagcagggaaagctgaaggtacacacacttctgaggcttttgttaaaattaagtatttaatgcgatcactttggggaaaccacattgattaaactgacgggaggcatgaaaatgacataattgatacaaccgataattttattcttcaacaaaatctactattggccagagtgcccctttgagagataatggttcatatcagggagcaatttgctttcaccccttgcatacaaagcgggtttcaaaacctatgtagtttcggaacaaaagaaaaactgtaatgtcttaatttttaagcttttttcaatgcagagactctaacaaagcagatctaatgaacagggcatcatattgcatactgtctgtgtgattggcgccttctggagttgtgcagaagacaacctgtgaggccatatttagccactctgggcttgcttcaggctttaagttcttgttgttaaacttaatttttcagatccatgtggtttggaagcattgtgcttatgcctaactttggtgatgtattgacctttgtggaccaaggatgaaagctggcatgaaataagtacaggaaacttcataaaataacagccagcattaattgagcacctacaaactgtcagagggctatccatctatgtgtctatctaatatttagtcttcagaataactgtgcaaggtagatatcatcaccattttacagatgagcaaaataagtcttagaaaggtttagtttagtaattttcccaaaagcacacacagctaataagtcatagagtgaggatgtaattttaggtctgatcagcaacctcaatatgtcattcatcctcgcctttcctctgaagaaaagcagcagcttgtcttatgtattttaataacactggcatgttataaaaagttaacctttttgttttgcagttcctcatttttctttatgtatttctcttgcttcttgttttttttcccctctcctccaatatcaattcctattcctcttacgtttttgtggcatttgagaaaccttcgttgaaaattctttgacagtgtctgcaagtcttctgagacaaagtgccacaaagataatgtttaaataaaataccacatagtacagataattatatttaggctttcagtcaccctgaatattggacaaataaattctcttggaatcttcatattgatgtacataggacacacacacatgcacacatatgattagaataattttttccaaccagaaatgacatttgcttttgaaatgattaaatattaccctcaccatcagccaagatttccatgacacttgaataaacaaaaaaggagttgattactgagattctttgtttttcctcttcctttgcacagtaggaaaagtaatgattaaaaaaagtataaaacacatattaatgatacaaaacagaactatctccaatgctttgaagaatgtattcttcatatccactagggtgctaaccttcggaaagctacaaaatcaatcctgaaagttttatctcccatggcgacagagcccttttttaagtcagtaaatactaaaagtgatacaataacagctcatatttaggattaccaagtttctctacaggagacaggctcaggtatcaagaggaaaacaaatattcattaaaataatttagcaacaacaaaagacacgtgatgatgaaagtctgttcaaataacaagtgactaaaataagagtgctgataaaaaggaaggtagcactgatatggaactgggttttggtaacaatatgccaatcaggaataaaaatataaatcaaacttaactggaatgcataagtatacccagctttacaagatgggtaggtttctggccgggcacggtggctcatgcctgtaatcccagcactttgggaggccgaggcgggtggatcacaaggtcaggagatcgagaccatcctggctaacatggtgaaaccccatctctactaaaaatacaaaaaaagttagctgggcgtggtggcgggcgcctgtagtcccagctactcaggagactgaggcaggagaatggcgtgaacccggaaggcggagcttgcagtgagccgagatcgcgccactgcactccagcctgggcgacacagcgagactccgtctcaaaaaaataaaaataaataaaaataaaaaataaaacaacaacaacaacaacaacaagatgggtaggttcctaaaaagctttgtataaatacagttgctccccaacccccataattactggaaggagagagagaaagaccctaatgaaatcttgcagtaaattctaaattacaaaccgaaaaaaaattttgaatggcaaacagacactgctttaattccctgcttggaaagttttttttaaaaaaaattttttaatgaatgatgatttgaatagcagtatattttttaaaaattaggcaaacacgtatatcactgcaaataatatggaaaatagtatggaaagtggagaaaacccccaaagagctaatttccattttatatttggtatttaaatgccacattgataactgaacactgtagtataaataaattattgttaaactgtcttataaattgctcagtccttcagtccatagtcaataaaatataggccttgcctgtggtttactcaagactatagaaattcagagtaatcaatcattccaggtggcttttatagctttccaggtagcaagagctatattttattgaatgaggcatttaattagtgggtattattaaagtgcaattttccatattaaactgttttctatataaattggcttcctggtatgctgacttgtaatgacaggattatcttgcattcactcttgtagagacaggtaataactcatctttgtgcctgttttttgattccacagaatgttattctttctgctgtcatcaaaaaatagtttctgaacaaatattatccaagatttttcttatgctattgtcctataaactcaatattttaagactaacctgaatgctaatattatatattgtgatatttcttatgttataaaggaaattgtaccataatttctaattgtagactaatcgcagccattctaccacaaaaatgccatattcaacactttttcctattacagtataaaacaccatttgaccttttattttaaaaagactgtgacaaataaatactaatttaatgcataaagtctaataatgatctagatttaccagtgtaagtgacaggaggtaaattaatatggaataagtatatacttcacatgtttcttggcatatatgaagaagcactgaagcaaatgaatctatctcatgtaaggcaaatattatggaaaaactccagaatcagtagaaagagatatttttgccttttcttactatggaaattcactgttataatacttaaagctgcagatcttttctttaataataacttctgtttaaaaatctgtaacaagagataccattgctgattacataacattggtgacatactactgtgattttttcagttctgtaccaaaagacaagaaaaaaacaaaaaacaaacaaaacgataaattctgccaatgtttttaaacaagaatgtcttctacaccaagtgctactttcagatacagggctacagtgcttgaacaatcaccgtattagaaacaataagtgatacaaagagtaaaaacaattttcaaaaaaatcaaacttttataacatttacatagacaccaaagaggacaaaatatccatttccagaagatgtgcagtataattagtcagaaaggtatcgcaatgcttttgattatgatcagccagttgcaaagattatcaaataaacaatctagctattgctgctttgctagaaaaatgatcatcttagtggcaaagattaataactgctttttaaaaagacaaaaactagctttgtgatttactgtgtactttctcaagaatgcacagtaagtaaatcaacagtttgtttaatcactatcaatgtggcatgctttaatatattggatataaataattgtcactaaaaaatcatctgctgcatgttcagataaagctgtagagatctctgccttgttacctagcaactgggcaagtaactgccatactgcaaaaaaaaaaaaaaattccttattatttaggtaaagagaatgatcataaaactccacattaagatgttaatgaagccaaaatgtatattaagatacaacagctaacgattttagatgcatttatggccttggttttgaaataccatgcagtaatgaaaactgtaaagatttaaatctattatttcagcttgtcacaaacaacaacgttctttagagtgtatttttaaaagaccactgttattattaattttttatttgtactctttcacagacaaaggaatttcaaccagatcttctgtactgagtctatttattgaaagggtgatgcttacttgtttaaatacaataaaactgttctgagtaattagttcactgcaagggatcccaaattatttcttatatttcatataacagcttaatgtattaattttataacatctggaggaatctggcttaagttctgtttcaattttgctaaaaatctggattccaagattgtgcataaaatctctcttaaaaagcaataggggattagggcaattataaaatttcacttctgaggtccaaaattcagcatatggccagtcttcaggcctcaatctgaaagtaattctttctggtgtgtgatgaaggctgactggtcagagcccatatgacgatggtcacatgagagtaaggaaaccactcatcattgcaacaaacagagactgttttgtgaacagacagagctgtgcttgatgaaggcttcacaggaatccaaaccccatagcttacatggcattcctctgttgatttaatgtacgatgcttttattcatagtcacttacaatgcagggacacaattcaagaaagctcttcaaattattgcatggaattaagtttcttgataaaactttacaatttaagataaattatgctgaaaagttaaagggaaggttggctttacaaattaggagccgaaagcccagagagattgagtagttggaagttgtgcaacgatataacttcttataaaagtaaatatatataaagtgcatagaacagtgcttgccacaccagaaggattatatgtgtttgatattgttattttttattagtgtaattattattagaagtattggatctagaatctgttttttcgtttccagaacaatgttcttttcactaagcacattacctcaaaataaagcactgttttaagatgcaccatgtacatcttctatgagccaaagctgtattttaatgataaaggtgtgtattaaatgaagatgtatacgtagattcacattaaaagcagaaaaaattgagtcttcataactagtaatttatagttatttgtttaaaatcaaatctgtatcaccttcaaatatatatcatttacaggctaatagctaaacgcaagtcaaaatggtatcccaaaggaaacactttactagtgttagtgtatagaccaagatgtataaactttcccatctttaaatattttctctgagttacattttcactaattcatatcaaccattaacctgttatttttatttttataacattaactttacatacatataacctgatacgtttgtactgaaagatttcagacatttgttggattaagaaaagtttactctgagcctaaagagttcatacatatgtacttcttgatcttgattagtatatattcatcatatgcttctctgtatttacattctctctccctagctggtctcatctaggcacgtggctttagaaactatctatttgggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccgacctgggcgacagagcgagactccgtctcaaaaaaaaaaaaaaaaaaaagaaactatctatttggggagtctctcagatgtgtatctagcatcctgatctttcccctgagttccagactagtagacccaatgatctgcttgacaattccatgtggatgtcaagtttctcaaacttaaaataccacaaaaaaactcttgcttccttctttcactagtagcctaatctgttcatcatccactcagttgcacaggccccaaatttagaagtcattcataactcctccctttttctcatctttcacattaattcattagcaagatctctaggttccatctctaaaatatacattccagaatctgatttaagatggaaaatttaaactgcttcacagaacttcccttcctcaatatctaaccaaaggagaaaaaaagagtaaacattagtaaaatgaaaaaaagaagttccaacagtaaccactcaaggaaaggaacattaacaactataataaacttcaaaactggcagccaaggaaagagaagattctggaacaggctaaagagacacagtgttccttggttcttaaccctgtgttcaaccctagagaggtaaacaaaattctgagactttttgctaataattctaaatttagagaaaaacacattcagtgaacatccttatgtttccttttactactaaggagtaataggaacatgtgcaatgaaagaagaagatcaaagggctgattcaacagaagtgaacactccagggctgcccactattttggggaaacccatcaagccccagattatctcgaggatagctactagctcttatggaaccctttagttaattataaaaaggctatccttggtatctctccctccaccaccccccttgcccgccccgtcaatttggtgaaataaaggctgataatggagacatttaacacaagttaaggaagcacggcccaggaaatctaacaaagattgcatacagcttgagttgagctgagctgtctacctccctctgcaatttctttaggttgcagaaaagtggatagatccaagcaataaaacatagctcaaagaggaagcaaactggtctccaagaaggtgggaagaaatttaagaagttactcacactatgtctggggaaagctgcccaggcaccagcaagatgaaaagaaatagcacggcagatatgcaagcattctaagggagggaggcaggaggagggaaaagagaggaaggaaagagggagggagggagagagagagagcaacaaagtgaagaaaaaatataaaatgaaagtatcacagcatataggaactaaatctagaattttattcaaataaacagaaagaaatcctcacacaaacttcctactgtagaataacgagttcaatgaaaattgaagtttaaagacagaataatgaagaaatctgaatgagatgaaaaaggatattgtggacctaaggaagcaaattaaggactaaagatcataattttagaatcaataaacaaatcagaacatcagaagcagagtagacacttctgatagttgaattactgacacagaagaaaggacccaggtaccatgaatggagacacttctgatagttgaattactgacacagaagaaaggactcatgtaccatgaatggagatgaaaatgacaacagattttcatcaaatgataaactaatagatatggaagagatgaaagatgatccaaaataaggataagtgatgttcctgaagtaggtaacaatgtaagtagaataaaaggtgttttcaaagatatgatacagtatctgatctaaataacacatcatattgtggaaaattcttaagcagaccatccaacacctccacatatcttagctatgttattaagctatgtggataaagaaagaattccttgggataaaggcagaaaaaaaatcacctacaaagggtggcctcagactatacagagatattcaatgctattaaacaatgaagtaatagctgcaaaattataatggaaagaatacatgacataagaatacaacgttcggccatgatatattgttcgactacaaaagcaataggaagacgttctccaaaaaacaaaacaaaataaaacaaaacaaaaaactcacaaatgcagaatccatgggtctttctcgaaaaaaagaaacaaaaagcagttggcaatgaaatctaggcaattcagtgatgaatcaaagaactcagtcagaatgaagaagatatactaaagggctgggaggcaatggatccatttgaacataggaatttatactaaataaccatagtaattatgattacagaatagaaagtaaatattataaacacaggcaatataaattagttaaaattgttagctgaggagaggatgggcaaaagcattacctttcaaagcaaggaaccaatctgatgtgtttaaaactggaatatgcagcttaaaaatgtgattccaactctgaggtggatttactgttaacgctaaggaagcttaagttccaaggttttttatctacacaggtgatttgcgttttcccatgccctggaaggggtcacagcagtgcattcatattgtcatatttttgtaaaatttgtaaaaatactccattttcttaaagagggcccccaaattatataaccttcccacagaaatcttgatccactcctgatcaaacctcttaacatttttcatcgtattttttcttaaccataagggaaaataataactcccataataaggagacacttattggaagttcaacaattatttagtttttctttattttttttctgctgttaaatacaataaaaccattttttttttgagacagtctcactctgtctcccaggctggagtgtagtggtgcgatcttggctcactgcaacctctgtctcctgggttcatgagattctcatgcctcagcctcctgagtagttgggattacaggtgtgtgccaccacactcagctaatttttaaaaaatatttttagtagagacaggatttggccgtgttggccagactggtcttgaacttctggcctcaagctctccaccggcctcagcctcccaaagtgctaggattacgggcatgatccaccaataaaataaattttaataatttttatttaaaaatagcatcagcattatgactccacagttataaagtctttctttctatccgcacagtcatgtatcaatccctttgcacatatttatagaaagatgccttaaatgatataagtctactgctaaaggtggttatttctgggcagtggtatttggggtaattaaaaaatttaatctttgtattacatgcattgtctgaattatttattgtgatcatataacaaatatttcaaaaataatacaatgacttttttccttcaaatgccaagatagtaacagatattattttggatggtgagaactatagggaactgttattttgtactttgtattttcctgtgtttttaaaatttcaaaaatgttttccaaaatttgatattctgaatcattccacatctctccctttttcttcttccagccaagtcactattatttctcacctggactactctcatagtcttctgtgtggtcccacctgtgtccatcctagccctggtattacccagtctttacacagcagccagggtgtgctcctcaaatgtaaaaggatcacacctctgctttacattccccagctgcttcatattgtctttagaataaaacccaaactctttgccacgaccagcaaggctgacctgagctgaccgggattcagtcacgctggactgctctctgtcccccacacactgcacttgttccccctgacagatattccatgagctgttcccctagcctggggtgttctttctccagcatctccgtatagctggttccttctattcaggtctctgttggagggccaccttctcagggatacccccaaattttctaatttctccctccatctccctctccagtgcttcaccctgctggatggccttcatggcctttatcaccatctgaaatgatcttctccatttatttatttacttcctttgtatcaatcctctcccactaaatatctgctctagaaaactaggaccttgtctatcttgttcatcattatatctcctgctcaaagaatgtgcccagaagatagcagacacttaataaatatttctccactcaatggatacacacagagattgtttctcagcttaaaaaggcttgtgtttgcaaagctgtcttttaagtcagttgtttagaattcagaatgcatgttctttaaaatgagtcacagtacaaattcaatatcaagcctagctcacaaagtctactggacccataatgagttaaacttctgtatatctgcaacaaaaatgctagaaaatcaacatgatgaattatcactgggaaaataggaaattaaaaagaaacatttcaactgatctaaatatgaacaaactatgactattatttctctctcatattggtgaagacttttgtgaatattctgaagggaacgtcagaaccttttttattttttttttttttgagacagtgtttcactcctgttgcccaggctggagtacaatggcactatctcggctcactgcaacctccacctcccgggctcaagcgattctcctgcctcagcctcctgagtagctgagattacaggcacccgccaccacatccggttaatctttgtattttttgtacagactggtttcaccatgttgccaagactggtttcaaactccggggctcaagtgatccacctgcctcagcatctaaagtgctgggattataggcgtgagccaccacacttggcttcagggcatttttaagagctgcagaagtttctggttttttattgtgtataacttcatccaaaaatgtgtagcttttggctcctttgataacagaccattaaattagaataatgtttgtaactatgagttttattatctgtttttggttttagttaaagcttgggaatgacttgcacgtagttgtaactgcaacaggtggtatgttttgtgaatgcttacctgtcattacttgagtcactgtttgtgtcaaaaatgtaaaagaggaacgagtttctgggaggtattaggaagagaggggctcagaaggaaaggaattaaagaggacgtgtgattggaaagatatctgagataagagcagcgaacgagaggaaagaagaaattagtgatgaatgatcagaagaagacagggaagacgacttcctcctgctagctactaggaaatgttatcttccaagacagcttggttcctgtctagagtagctctgggtgggtaaatggagggagggccagtttgtaaataacgctgaaatttaagagactatatattatctaatttgaggctttgtcccaaatttggtttggagtgagtttttatgactaatctaccagtagggtgaaataaatagcatcattcatatcaggagtaccaaccaaccccataagagatattgaagagacaatgccaaccttccattctggagtaaagctatagtgcaagaaaacaatttgaaccaattattttcatactaagttgacagttaagacagaaaaaaatatatatattaagagccaagagatactgcatatggtctgcaagtcttttctggagaaatgaatcatgaagataaagagaactggcttatttttacagttacattttatatttctagaaaaataactacaacatggtcttgatgtctaaacatagggaaatgagacttttatgaacgttacacaacacaaaacataccacttgttgcagttacaactacgtgcaagtcattctcaagccttaactaaaaccaaaaacagataataaaacatatagttacaaacattattctaattgaactatactttgaaaatgactgaatgctcaaatattcttaaaatacaatgttctcttgccaagaaaagagtgttggtcttaaaatggccacaaaacctagccccgtcccatgttactagagctacagaatcaagcaccctccaaatatatggccaagcagccttggaggcacctaatgagtccaacgcagtcttcccatgtgtctcagaggctgctgtctgtagtgacagaggtgatagaatatggtaaagttgcgtatctaggaaaatctcaatgtagtccctgatttcccagagaatgttcttgtggcttatcctctgaggttagtagtttcagtttagtacattaattccaaacactaaagagatgaatccattcaagtcatttacagaaaaattgttttgagatttacccaaaaaacaaacacactataaagaatttagtaacagagaagattagaacttgcacttttgcttctgctggttcaagttttgttctgatattctctgcatttcctatttccatatgagaaaaccaccagtacatctttgctgtgtgaataccaacactgagaaatattggccaaacataaagatttttagagaattaatttttgatattcatctaaacaagccaatatattctcacaattttttaaagaaaaaaaaaagaactcagcttaatcatatatttgacttctaaaaaatcatctcatgattccatgaagatagagaaaaaatcagatgaacaggaatggttttcatttcacactggaattataagaaaggttaatttttgcataaaaattacatctacataaaaataatttctggaacaatgcattattgacagttatgtgggaagataaatgcattcacgtaaatgttctttctcaagcaaattactaaatatattgacagcactgcactttgaaaacaaccattttaaggcaaccaaatacatatacaagagtaaaaacattacatataatagccaatgtaatgtttcactcaatgcatattcactcaaatatgcatactttttttcagtttattgatatatactgctattaaattaaatagcaaacacttatgctttgttgttggctattgcccacagaaggaaaaaaatgggtagtcaactggagcctattcacacttctgttaattactggtggtccatggaagatgttatagtttgattactagcacttgtaaatattaaccaagtctaagttactgctataaaatccaaaatgtgtaaaaaccaaacacacctatacaaatacaaatgttttactcatgatcgttaatgactttaatcaagcagatcttctaattaattttgctaattgttcattcctctcaggacatttattggtttgatggatattactatgacatatgttgatgccagcatctggtcagaaatgagggcatcaataaactctccttggtgtttctacagaatgtgccaatgctataaacactgtcaatgccacagcatttatttcaatataagattttgagaacatgtctgcctttcatttagagaaaggataaacctacttcgaaacacacggtgctcaaatatgcttattcaatgaatggtgcaatgagaatggcttgataacaaactggaaaacatctgccaacatttaaaatagaataataacatcataaacgattattaggaatggcttcccccacaatgtactctgtcaatttataccctatttcgaatatgtagactaactttaaacaaatatagtaccgctatcttaaaggaagtgatcccctaaacatttctgaccaaaggtaatcatatgcagtaaattaatagacaagaaatgcatcagaattcgattcatgtatagaaatttggctaaacttgcaaacttttatgttgttagtaactattcagagattatcactttaaactgctgacaaataagtgcacttatgcagttttatttttaaaaactagttatcccaaaatatcatattaaataatacaccatgctgtatctatatttcaaaattattttaatggagatttgatctccaggtagaggcaaaacactgttttctccttctggcccccattagggaaactgtaacagtatggttgtctcccgtttctacacatgaatctattgtcactctactgtcatggcttaagaaaaaaatattgcttctactcaaggtgccaaactgcaccaagcaaagtaactccaatgcagtaacattaagtttggcaactgcaggacaaggtttccatccttgaacaaggagcactgatacttcactattttgccccccaacatcatatttccccctgcattctgaaggtttttttaaaaaatatttgtaacaatgtttttgtatgacactggcatcaagtctcccaggcagcatgcatctgttttaatttcatttgtattcgttactcctttcttctctatctgagtccaagagaatcactgctaacacacccagcactactcaggatagacaacgacagaatgaaacacttctgaggaagcctttccggtggcataatgccagcactactcattatagcctattttatcacagagccgtcaacattacggactcgaataacccagataccagcggcatccccttgcacgagctcatctgcggagtacaaggaatacagatttggaagaaacctctgagaggttttctaatctttcctctcttccttctgacttctaactttaacgtgagcccaccccaaagaagagaactagactctcttagtaacttgtgcaaaccttcagaaaagtcttaggttgtacctaaattcctcatgttgccattccaacactatttcctgtagttttccctttccagatgcaggagtccacagagcaagtatccttataagtgtctaagaatcatcaagcaattccaaagttcccgtgtctctaatctactgatccaacgtgcccggcgcacataagcagcaccgcgactgaatttcaagtcttctcaaactcacacctcagttgctcagagaggagaaatgcagcgaggactcgccttcctggccagtctctgaaaacgcgaaaccttcctgagctgtccatttgttttaggggctgtttataaacggctggttttcttggaggaaaaataaacaaataaatacggggcgatggcagcatcctgataaacacaggaccttgtttggcttttggcaagttgtaacctggagtaaaatcacatccaagttacaagcacgcaaattggaatttcgctggaaacactgacccgaccttcaccgaagcagcaaatcgcagtctctgctgctctgctcctgctctccaaggcttaacattggaaagtccatgcccacgtccccctctaattaatcaatgtagaaagaaatacgagggaagagagagggagcacactccacaccaaccttgccagcttctattcttcctgctattccttaaaggcgatgcacagcgcacctggaaattacgtggacttggcatggctttttaatattaaagacaaacgacctttggaaaatatacactgttaaagtcaaaccatttggagagacacccagcaatttacctcctcaaactcctcggaaccccaagaatgaggaaaggaaatggaaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccggtggccctctcctgtgggacttgcgttccagctgttctcagagcgggtatgatcggcctccagtagacttggagggtcacgggtgagattttgataaggttcaaatactcctcactcctgcctccggtttccaccaaagttaccattgtactactaccaacagttgtggaaatttactttggcaaaggttttgtgtttttgtttgtttgtttttccccccaaaaattatgccaattaaatccgaccttaaatgacaaggcttttctctcatgtttaaaatcccatttttttccccttgccataaataaataaaaataacttgtggcttacaggctgcttaataccacaacattttaatgagcatgtcaggtaacccacaggcttcagttctttgttgcttacaagttccatccgtaagtgtgagttgctcacttagtctggggtaacaaccgcagattcccacagagaagaatcagtgtcttaaaacaaggtaataccaacccaatggtctatgaataggttggaatggcggtactttaagtaaaagtataaagaaatggttaacattatgaggaacttccagcagtactaataatcaaccctgttgttcaggagacattcacttgctaaactttaaggctaggcatttactgccttgaaagcaaagcaaatgaagattttgaccaactgcaacattcaggctctaaaatagaaatatgaatgaattattaaataataggtaacatttactgagcacttacgattttccaggcatctgtgcattatctcatttaattcttacaactctatgaaggtttcattatattatcctcactttacagattaaaaaaaaggcttagatctgcaactggtagttttggaagaacattcttttccttaaacaggaaactctaaatgccctctgttttgtccacctttgtgccactgtctgcttctgtgagggtcaggataatagtatacctgaaaccgcccttttagcaagcggcagggccaggacataagctcagactagatgtctaattcacttgctatacatgtaacatgtaaaataaaaaagacctgcatcttgactggtgtactctttgataaatgggacctgattacttgatggaggcatgtttgactatctttgtttatgacattagcaaactttcaatgggtttggaagtgaggctatttagttctgtgtcttactctgcaatccagacacctgtgacttgaggtaaagtaagtgttttcttggtttcccaatcatgagagtgaccgaagaatgacattttccaggtcatcattctcttgtggatattgttctctgataacaatattgggcaatctcaaagagctgtcatttcttggcagtgaactacaggctatttggaaaggaggtgtaaatcactttttcatcatgtccagtcctctgcactctagagtcatttgggatgttttgtgtctgcactacctctagagaatgatggaaatctaattctctgtcagcttttctacctggctagtgaaaatgcttcttgggagagctgggaggggaagtcgctgtccatggtggtcgttactgaagccccattcagcaaaatcggttcatactctaaatactggaatcctgcttaattaaactaaggagcttctgcacagcaaaataataaacagagtaaacagacaaccttcagaatgggagaaaatatttgctagctatgcatctgaaaaaggactaatatccataatcgataaggaactccaatcaacaagaaaaaaaaaagcattaaaaaccgggcaaaggacatgagcagacatttctcaaacgaagacatacaagtggccaacaaacacatgaaaaatgctcaccattgctaatcatcagagaaatggaaattaacagcacaatgagatagtctcacaccagtcagaatgactattattaaaaagtcaaaaaataacagatgttggtgaggttgccgagaaaagggaatgcttatacacaattggtgggaatgtaaattagcacaacccctgtggaaaatagtatagggatttctcaaagagctataaacagaactaccattcgacccagcaatcccaatactgggtatctactcaaaggaaaataaattgttatatcaagaagacacctgcacttgtatgtttattgcagcactattcacagtagaaaagatatggaatcaacctgtgtctatcagtgaatgcttgggtaaagaaaatgtaaatatacaccatgggatactatgcagccataaaaaagaatgaaatcatgtcttttgcagcaacacggatggagcttgaagccattatcctaagtgaaataaaaccagaaaatcagtaccacatgttctcatttacaagtgggaactaaacaataggtacaaatggacatacagagggaaacagtagacactgggaactccaaaagcagggaggatgggaggggactgaaactgaaaaattacctattaggtataatgtccactctttgggggatgagtacactagaaacccaacctcaccgttatacaacatatccatgtaacaaacctgcatctataaaaataaaaataaaaaataaacagctgttaattttgcaaaataagtaaatattacagtctggaaattaacttcatcatggcactaatgaaatttggtgatattctccagtactgtatattaaaacataaagatcttatcagtataatctactggttggagtaaaaacattaaataattcacaggagaatgactttttactctatggcactaaaatagcccctattcattgtcaaattttagatatttttaggtaccagaacagcataaaggggataaatcatttcctgaaaccctctcaccttacagcaaagaaaatagctacctatagaggttaaccaccataattagaagcaggcgtaaaaccatgaattcttgccacagaatcacttatcatgattctgtgatgcaccaggatattgaatgtcagaatcattctttcttcagtaatttcatttttttgcttaaaaacaatttccaatttatgtcatttgaaaaacagataatatatagtctgatgtaatatgtagctcatgttcatttatgtggagtgtatctaaatcttataatattctagctgtattaagtaatattgtttcctgcaaagtgagacagtagaaaaaactcttatggtaccaatttctgaccactgtaacccagtgaaaagcaaagcattaatttcattacaggtcatcaagaatgcaaccgtcaacataaactgcttatttaagagcagccattttctatcagaaaggactaatattaaaattccccactttcctatattctccctttgtattaaaaaattatccaggggaccatgttgaatattccagtctcaaaaatccaaagatggtggtaatttttctaagagatatgtaaggccctttgtaagatttagaggaataggattttaagagtttattcatttgtttagtagtagtataatgcaatagttaatctcctgactttggaataagacctgtggattcaagtcatgggtatttaacttaattgttttgtgatcttgagtaagttacttttttgagccatgctgttctaatttgtgatatgaatgtgataataatgtaagctacttcacaagagttgtggttggaaataaattagattaccaatatgtagtacttttcactaagtaccacactacttttcactaagtaccacacattggtaatatcatttggccaggttaaagtttccatttactcaatcaaagactaatctaggtgtttctgtgaaggtattttgtagatgcaattaaagtctatagtcagttgactttaactaaaggagattatcttagataatgtcattcaactagttgaaagtccttaagagcggcttccctgaagaagaaattccacctgtggacggcagtttcggctcatccacaagagttttcacctgcccttcctaatggcttgccttagctcagtcttgtccagccagtctccacaatcatgtaagccaattccttgcaataaatctttttgtatatgtctcctactggttctgcttctctgactgaaccccaactaacacaccatgtaaagcattaactatagtatctgtgacataataaacactccaaaatattagttaattttttaaattaacccttattgaacatctctcacatttatagcactgaggtatacactctgataaaaatgtctgagagctctgaaatagaatagggatagatagatacttattgtctccaatgatagtaacctcaaccaggaagggatttaatgttttagtaaaatttccaggaaaacaagggaaaagtgccaatgggttgattattccatctggagctatgtaggggaattatgcaaattcagtatgaggccagtttcctgggttaggaagacaatgaacaaaaaggcagttactgttttctcaacagatccatatagatgtagcacctgaaactagacacaccagtttccatggatcaaccatggaattccattctgtaagaaaaatttatttacgacttggtcttaagccaattggaattatatacttgataactgccttgagattcttggaggaagaaatacgctcatatttaagagtattaaagtaaaagatctttcttatttcaatgttagcttatcttagtattctacattgttagatctttgaatttgttttgtgcatttttaagcaaggaaaaaatacttatatcactaaaaagcaggcatagcacaaacctacttaaatagaatctgcctccgtccttcagaattataatgccaaacttacaaaacttaaggctggaaatatctcagatgagtaaacaaacctcagggaggtagtctcagatataaataggattaaaaggtgatgagaaagtaagagagagtgagagcatgccttttggttttatattaaagctctgataatttagagtgaatcttagaaatagaaatgttttaaattgtgtgtttgcaggtgtgtatgtgtgtattcactaaagacagctgtcccatgatcctttatgccataatagtaattttctcaaaggcagtgctattgctgtaaaaatacttttactcattatgcaaagatttattgaatacctgtgatgtcatatgtcgagctggttgctaagggataggaaagtaaattagagatggactctaatcttgtggaactctctctgggcaactctaatttatccttatggatttcaactaacacgtgactttctctaggaaatttttgtacttcccttgctctgcactggcctaggcagttctcttttgctctcacagtaactttgcttccactaatattgcatttatcattttttttagtaattagtcaattgcttataaatctccctataagactgcatgaggtcaaggaccttgtttatgtgaacctctatttttgctcggctcttgtcctcaaataggcattaggtaaatatttacagaacgagtgaaagaaagcttgggacatgttgaattttaattgctttccaaatagaaatatgcaggaagcagaaaatatataaacctggagctgaggacagagatgggtgcaagggatacaaatttgtattagctgattcctggtagttggaaggcctgggtggattatcttcaatgaggctcacatgtagaattatgaacgagaaagtctgaggtcaggactctggacagcgtccacactctccattttatctgtgggatgaaacatggcccacatggctaggatggaaatgttttgggaaacccaaagcccaaataaatcttttcaaccatgtgagtaagtttctaatagatatttcagaactaagttactgtagagacaggagcactataaatatggatttataatcatgacattgtggaactttacctcccaatatgtagagagcagggttttcaatttcgcaaaataaataaatgaataaatgttagcatatgttaatagagggcacaaaatagaagtcagagagagaaagagtgtctgtggggactcaacagactctgtgggaatcagactctctgattttctctctcaatggaatcaaggagtcccacgagttaggcattgggaaaggctctctgggtggtgaacagacatgtgtggctattggtggtgaatgtccaccacagaagcagcgtggctcttccttatactcaaggcttttttttgccattaatgagaagtaagacacagactgactcccagcacttaccaattttattattcttattgcctcctcatactttgccatgggaaaatccctgtttggatcacaaatttaaaacaatagactgcctgttaaccatgggcatatttacagatctgactatgagctaatacaacccagagtgagcagaagggacttatactttttcctgaaggcaagcaggcttggaatccaaggggaatgaatataaacactgagacccatctgccccagtcttctgaattaaaacctagggacttcttttgttaactctgttcaaggcccaaaccacatacagctccattgagccacagctaagatttttgcttgcagcctttgcttagaactggcccctgagagtcagtttcatctgtacagcacagttggtaagtacctcatccttcccacacctttaagcaacagaacagccacagtcaacacttacagcaactttcaaggttagcaatgaaagaagaaggctgcagtaacctcatctggatgcctgttttactaagtaattatacatcccaaatttcacaggacaaccttctttaaatgaatcagatcataaaatctgatttttcacttaggaaaatatggttaaatcatattagagactcatacttggagtcttcaaggaggtagcataatatacagaaaaaaagtccatggactccgaccgtggttcaagttcagctctatcatatttactggttgtagaccctgagcaacttgcttaacctgactgcacctcagtttctgcatctgtaaaatgaggataagtgttctttaaagatgttgtttaaggattaaatataagtacactcatataaaaatctagcacaatgcctggaccacaataattattcaaccagagaatcaagttcaccctagtacaaattcataagcattcagaatcaagaagttattccagcttatcaacagaactaaataataaagctcattcccacagcaccttctagtgtgcttatcagctgtgtaagtgaggaggagcccatgaacttgggaggggacagtaactttttatattgtagactcataaaaatgattttatttttttctctacaggatttttagaggacaaaatagtctctcatttgatggtgattatgtacattattatgataattctctaggaatgcacattaaggattttgaaatatattagaaggacaaaggaagaaagaatgacataataaatattaaaacataatttggggttgggataattgaatcttaggataaaatatggctgatggccattgttttttcctgctcaacacccggtgctctatttctgttaccaatagtctgatttgttactggggacccaactctcccacacttagctatgaaatcctagataatcaaccttaaaagagctggccatggagtggacccatgagccactggccaagcagaagattccatcatgcagccacagtggtttgttcagagacggtcagaaccaagactgttggaactactgggaaaaaggggaactcttctcactggggcttctgatgatgagcttggtattaccagggtgccaggtgtaatgcctggagctgccaagggccatcttgtggagagggtctacccaagagtgaagccagcgcagagaaaagcagagcagagatatggattggagtccagtgatagtttttgaggctctggatccagtcatgcctgaaacctttggactttatctcttatatgagccaataaatttttcattttacttcagccacttggagttggatttttggcagttgtaactgtaaagtgtcctgatttcttcagcagggaacttaagtataatttatctcaacctcccctctgatgtttgaatcttctctacaacttctaatgaaagagtcactcaatcaaggcttggactcctccagtgatagggagctcattaccaactgaagaagcccatccatctttgagacttatattactgcaaaattttttcttatatcaagtgaaggtttctgaaacctttgtaattaccacttattttgtacccagtagaggccagagaccctgtgctatgttatacttaaaaatatacattgtgatttaattctcaaattaaaaatttgaaaattttatttttgaaataatttaataaattaaattaataaaaattaatatctaatgatattaaaattattttagaagctgctgcacaaatccaagtgagaaatgatgagaggctgaagcaagggctatgggggtggggataaagaagatgaggagggatccagtgatgtacagatgtagcatacaggtgactgagtggagggtgagggcaagagtgaaacaggagacttggagggcctccagaaaatagacaggtgttgaaaagcagggagaaacaacctggatgggaaagatgaaggttctgctgtttatcccaagagttaccataagtcgaaggggtcactacttccaaggacacatgatagctctacaaatttctttaaaattttaactgaatctggtttagtgttaagaaataatcatgaacagaattggatgtgcatcaaaagcaaagttttagaaagacctgcaatttttgcacagacctttaatcacatgagtgcaagtcagaataacacttttatgttcagcccttaagactggtttctcccttctctcctcctgccagtgccccagaaggcagaggagaggatccagagaactcagcacgaagatgcagcagagtttgcctgagccacaggggatgggagtctgaccgtgaggtccaggaaccaaagagaagtgcattccagtggaatatgtttctaggaatgggaaagagggagaaagggaagaaacattttatgtatacctactatgtgccaggtcctttttatgtaggattattattattatttcagtatcactttttttttttcccaaatgtaaaaactgtggaggtctgcaaagttaagtaattttccaagatcaagcagcattagaattaagtccaggatgtatgtatgcctctgagatctgtaatttcttcattatgctatgctgtctccttaaataattagcagttataagacgcaagttataaggtgacaaaatacattgacatggtatctggattaacaacaacccagaaggctagtatttctaatattgtttctattttatagatgaggaaactgagtccctaagaggttcattgactagctcaaggccacacagctagtaagtagaaccatagctggaactaaaaattcccatctccaagatctgtgtattttcccatgacactgcagctactacgctgggcaagctactatgaagctggactttgtcagaacagtgacagataacagctttgctctgaaacgttctttccttcaaaggaacgcacccaacctaatgcttgtggtggcgcctgctttcacccacattggctcacaagagaaagactccaaggaaaaaaggaatgagggtccctagagtttctgatgagggtagggcggaggtgctttcaaggatggttaaccctctctcagggctgggcgcaaaggctcctgcctgtgatcccagcactttgcggggccgaggtgggaggactgcttgagttcaggagtttgagaccatcctggacaacatagcgagaccccatatctacaaaaaatttttaaaaattagcctggcatggtggtgcacacctgtagtcccagctgtccgggagggtgaggcaagaggatcacttgcgcccaggaagttgaggctgtagtgagccaagatcgtaccattgcactccagcctgggtgacaaagcaagaacctgtctcaaaaaaagagaagaaaaagaaaaaagacatgagacgtaggagccaggcatttttcagccacaaataccaagtggataaaaaaaaataatgaaaagaatagaagaatggttagcccactctctttctagtgaaccctgggataaggtctatggtgcagtgctgtgaaaattcactcaatccacgagatctatacactttgttgggacctgggatagaatgaaccagtgttcccttagaatggaaatgactgagtagaaataatgtgggaagccacattaactctttcaggccattaggctatcatttagtaaattactacattgttctaaatgggtccctagtgggtatggagggtgagaatgttctaatttgcttttctctcctttctctcagctgctttctcctactatgatgtagaacaagaagtggtttaataactgctctattccaaatcactgaatgctcttataactactgcataaaagtgcccctgcaggtctgctatattgaaatgtgtggaatcaaatctatgcatatgatatgaggggtgggggctgcaatctggtacccacaggatctagaagtaactcgaggaaccaggatatccctgattttaaattctaggttaatggagggcgtgtgaccgagagccccatgttcctggggagggaacagatgccactggaagctgcagggcaggagtttctccacctaaaagggaggatccacaactctgatctgaggaggagtccgtgtctctgccttggcatgtatattacaagagaaaatcataggaagggcaaggatgttccctgacgactggcttccctctgtcactcaggatgcatggccactgttggttgaaggaactatcatttttctccctgattgaaaaacaaaagaatcaaagctctcccttgtgcttacaaatctggggatattaattaaatacctagtagagatgctggggcctaatattattgcataatggtgattacagcaacaatgcattatatagcattaaatgtttttgaagcactttcatattcatttgttttttaaataatttttgtttttatttttttccagtttcattgaggtagaattaacaagcaaaacatgtacacctgtatgtattcaaggtgtatgatatgttgttttgacatacatacacactgtgaaatgatttccacaatcaagctaatgaacatatcatcccctcacatagttactctgtgtgtgtgtgtgtgtgtgtgtgtgtgtgtgtgtgtgtgtgtatgtatggtgagaatacttaagatctgctctcttagtgaatttcaagtatacaatacattattattaactatagttaccatgctatattattaggtctcctgaacttattcataactgcaagtttgtaccctttgtccaacatctcccctttgcatattcgttgttggtcagggctatcttgatggacatatgaagatgggctccatgcttggtttaattctctgcagtcacagtcttgtaattccaaataactttaacttggaattagtattttgtaagcaaggtctgatgggactgtggagcatgtgctgggcttggaacctcagcttgatgccgtcctgccttcctgggatgggtttttggctgccagctccctgtctcatgctggtcctgctcagggccctgcccactccacccccttaccccacaaccactgctgcaatcaggtggcactggcagggggaggaaagagaccagcttggattcagtccttgaccactctcttcccccaatggtggtggtgggggagtctcgacatggacggtcatccacctcatggctttttggggtaggcaaggcagcagccatccttgtccctaattgcaacatcatggcttgtttggtgggtgatatagtttggctatgtccccacccaaatctcatcttgaattgtagctcccataattcccacgtgctgtgggagggacccagtgggagataattgaaccaaactgtttaccccatactgttcttatgctagtgaatcagtctcacaagatctgatgattttataaggggtttccacttttgcttggctctcattctttctcttgcctgctgccatgtaagatgtgcctttgcttctcctttgccttctgccaggattgtgaggcctccccagccacatggaactgtgagtccattaaacctctttttctttataaattacccggtctcaggtatgtctttattagcagtgtgagaacagactgatacagggggcaatacagttggtgactctgcatgagtctttcacccatctctgactcaagtaccaagcacatcctggcctagggattgtaatctgttgggtagtcacctgtctgctgtgggttgggagtggtgggcctgtaggaaagggagattgacttccctgtccctggccaggcctcacagtttcattttataccaggccttgcaaaatatatagccagacctgtagttgacatttattgtaatatccatgcaagctggataggacaagaatgttgctactgttatgtctgcttccattatttctactgctggggaggctaccattaccttctctgtgacttgcacttgggcaagcacttaacaatatatcatcccatttaatcttcacaaccaatatacaaggtagggtttatacactggggtggttccctaacttctctgagttttagtttcctcatctggaaaactggtatcataatgcctacttggtaaggatattgtgagaattaaataagatgacatgtatattaagagatggaggtaattttatctacctgcattcctctaattctatatttgttaggaagaaatcttttggtaagctgcttgaggagaagagtcaccatggacagactaaaataacccaataagcttgcttaacttttgcacttatgacaaggagtagtgtttgttccttgccattgttcccaagaggaaggtggcaaagaaagagttggtgagggcgaagcatttgcaggggaagagaacaggagtgacagtatgtcctttagaaagtggaaatattgaatggggttctaaacaaattgtttggttgggtttatgctataaacagcccaacctacccaccgtcatgaaatcttcagtaaaggctgtgtagctgactaacgcttttgtgtgtgattagataaatgcgggagaggggctcagtgtctgttctcaaagaggcattgaaattcacatccacgttggcacaagtgaaaacagacagcttgtgccagaagatgagtgcagagctggtgtgtggttctaatactattcttggaatgcttcctctgagtgacctccctctctgttcaggccacgcatttctggagggtataacagcagtatattgttatattgtatatatatgtatattctgtttggtttctattcttccacaggccccaccatcaggttccgcacagagtgaacactcaaatgttgagggctgataaatgtgagtagcaactactaaatgaaggagatgaatatgcttttgtatagtaacttcaacgatgctttgatatagaaattagtttacctagtgtactgatgaggtacatgaggctcagagaggctaagaaacttgcctggcgtcacacagctagtaagcagcaaaaacagacattcatgttccatacacaatgccttcctggtcagtgacactttagcagactatctagagttctggcatcgtataaaccaggcattatccacatatgtatattttaaaacctcactgaaagcagaaggataagatgaattgactttaagcattcctggggaacaaaaagtcaaaatggaaaaggagaacaggagcataagaaaaaaatatatagcataactcgttatcccttagataactgtagggtcatgctgatattagtcattgtactgtgatgacaccaaaaagggaaagtgtaccagctagccaggtagatgcaattcattgtgcaagaaaaggctgcctcaaatgtgtctaaaagcgtggttcttcattcagccaagtcaagaccaaaggagcacatgaataattggctacagctcccctttcagcaagtaccagctttctctgctgaggctgatacagctccatacctcagggggccgggaatcagctgccagcagccaatgggcttctgagcattcataagcagaccaggtgctgatccatcaggctaattagcagcctgtgggccacagttagctgggaaggtggagggttttaactcttttcctgacagactccaagcctatctgggctttttgagcaatgttctatcagtcaaaccacaaagaaaagtattagaattcaaaaggagggaagctaaaaggaaatatagttttgctttaaataagacaagggagactaacaacacaaaggaagtgaactttgactctcaaatatacatatatatagatgtatatatgtgtctgtacgcatctcagtctacgtatcttcatgttactgactgtaatgtcatcaccacagcagacattcaatacatgtttgcttttgttgaggatgatatagtgatatttaaaacagaaataataaacaagggaagaaaataggacaggattgcaagggagggggatatttagcttgttggcacctgaaatgtatttaattatcaggctcccaaaagagcagaggaaacagaattagcttcaatgaaaaatacagagaacatgctgaaagttcagaaaaaatgcaaaacttactttaattaggagatggagatggaatacatcagaaatagtgtcactgcaaattaccagacttataaaccaatatgtaaatcagcagaggaaacaatcccatgaattttagtaaatttgtagaaacttgttgtaaatagtgcatttaaaattagttttaatgtgaaatagaatcaacaatcaatgaagccaacaccatccaaatgtcttcattgacataaaaggagcattctatagtcaattggttctatatttttgactttagtgtggttttgttgatcatggatccaataatctccagtgaagcagtgccaatatatgatctagcgataggaaataacaaacaagcatcctaatccttaaagtagccaaatctgacaatcatagaaaatggcaaggcaggatactggcaaaagtcttaaaacacagaggtaacatttatggagatgtctgcacgggctctctgtcaacatatggagaattgaggaagagctacgggatttcaatgacaagcccatcaccaccatctggagataaaaattctgtggtagattttttttttaaactgtgatattttactgataaattttatattagtgacaagatcctaaccaaagtttccttggactgcttactataaaactgtgtactattgactctggggttaaaaaaatggatttatgcctcactgagaaacagctgtcattgcatttgtagaatcatagtgtcaagatgatgaaactgagctaattccagagtcttcagggacctaaagaaagcattatacagccctgaggaggtttgggtgtactggcagtaatgtcaactgtatggccctgagaaactaatctccatgttgagattatgaacacaaatctttccccaaatatttactgagtaaaaacatagtgagtggtccattagggagagcaggagcatgagttggattgtttttgttctaagaaatgaatgcactaccttggactataatcaatttggggattgtggtcttttaaacagaccatagcagatgattcagtgtcagtgggccactggattcatgccaagtgataattctccataacgcttcctacagtctggtgtgtgcaaaacaggcaaggtcacaagtctgttctacagccaccgggtgtgctggtccttttattgtcctggcaaagtaacaaccctgtgtatgcacccctacaaactatctccccatggtttggtcagagctgacccccaagctcaccctgcctaagtcatttattactagcagaggaagaaataagcatataatcatgaccttatctacttctctagcctcaaatctagtctctcctcaatcaaaccctttcctatccctcagggacaccttgactgggtgcctttgcctgtgggactctctgcccttagcatctttcaattagttctctgcctggaaggctgttcttctttcatgtgttacctcctcctgaaatggtttcttgataataacagcaaacacataggatttgcttcataccaggcgcacttctaaatgctttattaaatgtacttacttctcaccagaaccctttgaaataggtactgttatagtctctactttagatataaagaaacttaaaggcagagttgttaagaaatttactcagggtcactggtaaatggtagagctgaggttatgaaccatggcagcctggctccagagtgtctgttcttcatcacgactctgagcataatgatccctagactttgctgttagtatcctgagcactcgctaccagagaagtagctgcactgcactctagtcatgtttgtaagcttcctctctttccatgctaactccagttaatccaacaacactcagccaaagcatcaactttttcccccttaagtcttcctgatcctgctcccctaacctgtgggaggtgaatcctccactgcccacaccatgcttctctctgctagactccttatcacaccacgtgtcttgtttacctgtctgcctccctcattaatctgtgaactctgaagttttgaaggcacgaatggtctcagtaacacagtatctggcatatagaactgttgcttaataaatatttgtctgtttgatggatggagactggtgctaacaagtcttcattttgcaactctggtttctagcttttaccggcagattaagaacaaaagggattccatcacaaatcctgggagaatcatgacaaatgcttagcttcagttcagaaagaagcaagactatttatagctcagggactcaacattaaatgacccggacttaatttttccttgtgacctagatttgcacaactttagatggaaagtgcccttggagatcattttacccaggtattgcaaactggtggcctagagttgtttttatttgacatatattatttgtttctatttttattagaatacctttagacaggacatgtgctttttatttctccacattttacatcatatcctatcatacaccactttactcatttgtattatccacctgaccattcaaagcatttgaatatgaaatgtctgaattagtctaactcattttttttggtctttgtttacagtaaagctcccaagtctgtacttagggtctccaattttctcattaattcattccagtcagatgttctcccaccctctactgatgtgtagactgatttccatgtaacaatgtaccaatcatgtaccagtgatttccacctagctaaatccagttcctagcttggacctcaacccctcctccttgacattcaggaccatactctcctggttttcctcctacttctctggcctccccttctctgtcttcttgctgattcctcctcatactctcgacctctaaatgttggatcctccaaggtgcagctcgtggcctgcttctcttctggatctactctcatccccttggggatcttgtacaggctcatgagtttaaacactgcccacatgttgacacttcctcagtgtacatctccagctcacttggttgtctagtgggcctgtcaaacttaatatgtctaaaaacaaactgccaatttcttcatattttttttgttgttgttgagatggagtcttgctctgttgcccaggctggagtgcagtggtgcaatctcagctcactacaacttccacctcctgggttaaagtgattctcctgcctcagcctcccgagtagctacgatgacagacgcgtgccactaccacacccatctaatttttgtatttttagtagagacaaggttttgccatgttggccaggctggtcttgaactcttgacctcaggtgatttgcccgccttggcctcccacaaactgtcaatttctaccccaaacctgctcttcttagcagttttctttatgtcagttaggggtatatccgggccaccagttgctcaggccaaaatccatgggcttatctctcattgcttcctttctatgtgatatggtttggatatttttcctcttcaaatatcacgctgaattgtaatccccggtgttggaggtggaatctggtgggaggtgtttggatcatggcggcggatcccttatagacggcttagctctatcctcttggtgatgagtgagccatgagatctggttgattaaaagtatggtacctccccactctctcttgatcctattactatgtgacatgctggctccttgtcaccttttcagccatgattgtaagcttcctgaggcctcaggagaagcacatgccagcaccattcttcctataaagcctgctgaaccatgagccagacaaacctcttttctttataaattacccagcctcaggcatttctttatagcaacacaagaacagtctaacacactttcatatgccatatacaagtcctcagcagtcatgtctactccaatcttccagtgcctcccttgttctttaagagtaaaagccaaagaaagtccttagagtggtctctaggagccttgatattctaccttccttccttattcctatccctacctttatttctcagacccccattcccaccactatcccccttattgacctgcctccagctcactggcctcccttcactgttgagtgaacactccaggcatttttctacatcggggtgtttgcatttgctgttccttctgcctggaatacccccacccttcccttccccatccccaggtatctgcatgtatctgcatgggttgcttcctcatttccttcatgactactcaaatgaacctcctcactgaagctttccttgaccactctatttgaaatagacttccctaagccaggatgatttttcatccctcctttctgcttttctctagagcactttattaccctctaatatcctatatattttacttacctattttgtttctcttcctactagaatgtaagctaaatgagggcaggcttgtttgtcttctttgtttactgctacatcctcagcatcagaataaggctgagaacttgttatgggttgaattatgttccccccaccacccccagtaagtcccagtgaccttatttgggaacgaggtcattacagatgtaattagttaagatgaggtcacactggagcaggctggacccctaatccaatatgactagcgtccttctagaaagaatggcatgtgaagagaaggagatatccatagagggaagatgatgtgaagatgtacagggagaagatggccatctacaagccaaggagagagatctggagcagatctttcagacttgatttcagacttctaagacttctagcctccagaactgtgagacagaatttttttttagacagagtctcactctgttgcccaggcaggagtacagtggtgtgatctcagcttactgcaacctccgcctcccaggttcaagcgatcctcctgcctcagtgccctgagtagctgggactacaggcatgtatcatcacacccagctaattttttgcatatttagtagggacgggctttcaccatgctggccaggctgatctcgaactcctgatctcaagtgatccacctgccttggcctctcatagtgctgggattacaggcatgagccatcgtgcctggccaagacaatacatttctattgtttggaccaacctgggtgtgttactttatcactacagccctagcaaactaatactcaaaaaaattctcaagaaaaatgtatgggtgaataaacaagtgaattaatcctttcaatgaagaaactgaaggccagtgaagttgattaacttgccagaaacacaccatggtgaacgggcagaaccaagactcaaatccagctttcctgccgccccatctagctctcagccaccacatctggatgccacgtcagtctgtctcatgagcactaacaatggtgggctgaggttgagggggatctccggagccccttcaccatctcctaggtcttgcctatcctgccttcctgcttaacgctcccaccaccatcacataacctggatatgttgtggccagacaattattgacgtatgtttgttaagtgttctgatctcctctcagaggaaaaccctgtgtttgactcttctattattcaggaagtaataaaagttatagtcataatatataagaaaaaagaatgattcactgctgagctactgagctacagggagcaatccaaggtttagaacagacaattggctaagatcagtcacgatgatgtcacagcggaatatacaaatacctcagtgggctgatccaagagaacatcacaattaaatcagcttactgctgagcactcttccacatctgtgaagagctgctctccattctgacagccacgtttaaggaggtggtggaggcggcagtctatccaacaccctccacacaggaagaaaggattgcaaagtgctactgagtaaatgaacatcattcacatggaaatgcactggacgagatcatacatgttaagacagttaacagacaggttaggaacaatgttttcttttcagaatggaattacagtatgacattgggcatgggaaactgatgagagccatcagagatgatattcaaaatgtttaacaaaatatcgacagcataagccatcaatggccaatgcagccttatcaatgcagagtggttgaacatggtgctggtgaaactcacttggctagaatagcagagatgccattaacctctctgacccttagtttagtttcttcattgcagagtgaggcaccaccacttatttcctagtgttgttacaaaggttaagaaaaaaatctgtgccacaattcctggtacatatcagatccccaataataagagcaaacatttatgtgtctttattatatataaggtattagcaaatgctaatttacttaacccttatagcagccctagtattcaactattttttttttttttttgagacaggatctcactctgtcaccctggctggagtgcagtggcacaatcacagctcactgcagcctccacctcccgggctcaagtggtcctcctgtctcagcttcctaagtagctggtgctacagatgtataccaccatgcccagttaatttttaaatttttcgtagagacagggtctcactatgccacccaggctggtcaagaactcctgggctcaagcaattattattagcattttcccgttggagaaattgatatagagagcggttaagcaactttctcaatgtcacactgctggtgaatggcaagacagggtcttaggacccaggtagaatgaatcccaggggctccttccccaccctatgctaccctcaggaaatgtcggggcccatccctcccactttatgctccagagagccagtgtccctgcaaacctaacatctcattgcctcaaagtcccagctaaagcctagtggagaggacatcactctttggtccttcagtgccctagcccttctttctaggtttactcaatttccatttgcatgaagacagacaagaaaaacagtccaattaatacgaagcgtaagaccacaagatgagaaggcttttgctttgctttttattttgtatcagctgaagtgctgtgagtattcgggatgaaaaattatttatcccagttaatgaatctcatgataataaaaatgcctgacagctctgagattagtgagtagcccttatctggggaccacttagtgaagcaaatcctgcgtgaacaaaggacaaatgggatttgggagaatgaggaggaagggaggctaagaacgaacatgtgttttgcagctatctcatgccaggcatcacacaaggtactcaaccctcattctttcttttaattcttttgagaactcagtctttatacaaacacttatggcagtgccaggtaccataataagtgttggggttacaaaattaaataaatcatggcccctgtccttttaagtagaatggatacagaaaataagtagagaggctatttatgttcactgcaatattagtttgatatgagtatacacaggcagtggaactatgctatacaggccaagatgatacctaccatgtcaatagttcctgcataaggactatttcctgcatacgcagctgtgttctgggctgggtgatatacccctgcacctccccatggcccctcaggcccttcacggaggttagttggctagaggagtgagattctcttaggagtttacacttggaagcagaaagagaatcaggcaattggttgtgggaacagaaactgagaagatgatctaaaaggagtgatgaagtacagtagaatggggctgggtgggaccatgtgtaagcggaagctatgaatacacagaagatacaaggcacagaaaacgctgagcagaatgtgaggaagctaggtcgtagcaggaaatgaatagaagcagaggatactctaaccaacgtatgccccacaatttaatcctttccctaatgttagatcattctcattttttcctgtattacaaggaatcctatgatgaatatcattgcacatcagtatttgtagcatttctgatgagtttctctaatatattcttggattaaatggtatgcacattttaatgctcttgagacaagtatgcatctttatttccaggaagatagcactaatttcccacgcccttcagtattatatgagtgagtctactttaacacattgtctcacactgagtccttgtcacttaaacagggaacggtagtaactacctttttaattgtttaattatttaatttttaattgtttgcatatttttcatatgttatgggacatttgtatttcctcttttgtgactccagcttgtttatgtctttttgtccatttgcctataaggccatttataatgctcttattgatgtatgagaaatcaataaaatttatataacaagaccaatactcactgacatatttagcaaacacttacccataattagttgttttccttttcatttttatttgaggcacggaagttttatatttttcaatatattgatattttcctttgtaatttgtttcaaagggtttctttttgcggaaaaaaatctttttctgttttctagatcaggaaaatacttggctctgtttcttttcctacttttggaaaatgtttttgcttttatatttaacttttctgttcacttacaatttattttggtgtatttgaacctttatgaaggaagattttgtactaaattaaaaaagaggatggtgtgatcctgtttcagaaaaatctaatctgtgttaatgtttgttccccagcagaatcaaccatggattacttccaatgaccagtgcaatgacttgagcacacacagacccatttaaatacataatgagggagaacatatgatcaagggcggagatgccatcatttgtgctctgtatacaacctacttttattaaatggaaattatggtcactgaataactcaatctacctaaactcttacaaggaatcagaagccctcagttcttaagctgggtctgtactgatttacaatgggacacaaacacactgtacctccttaaccctaacacccactttccaattgcctgtctttcaaaactatctaattagatttctttaaaaagaacatttttgtcatttgtgaggaatttttcttttcttttttagtttgctcttactgaaaaaccaaggcaacttcaactttatcttttcatagggtccctttccaagtgttatgactgaatggaagctgtgtggttggtgaagtacttcggctatatttccaaaaatatgcaattgttaggggctgcaatgcaacagccagttccagagactagcaaaaggcagggggatactctcaagagtgactacactcgagactttccatttcagcaacttcaggaattggggaaaactcactaattcaacactgagttctctgaaagtgatggtgtattagtttgctaggtctaccataacaaagtacagcaaattgggtggcttaaacaacagacatttgttttctcagaactctggaggccagatattcaagatggcagcactggggagaaaatctagcttctggtggtttgcaggcaatctttgacatttctttgcttgcagaaacatgaccacaatatctgtcttactcttcacatggcattctctgtaaagccacactatttgcttagattgtttgaagaaggcactttcagatgtgttccagaggctgggcaccttgatctggatcaaacgctgccaattgttggttgaaggtgagtgtagaaatgtatctacttccaaagccaaaatattactgtattagtccgttttcatgctgctgataaagacatacctgagactgggtaatttatacaggaaaaagggtttaacggacttacagttccacgtggctgggaggcctcacaatcatggtggaaggaaaggaggagcaagtcacatcttatgtggatagcagcaggcaaagagagagcttgtgcaggaaaactccaccttataaagccatcagatcttgtgacatttattcactatcacgagaacagcacgggaaggacctgcacccatgattcagttacctcccacctggtccctcccacaacatgtgggaattcaagatgagatttgggtggggacacagccaaaccatatcaattactaagtacacagaaaaatttataagtcttggtccatgtacctcatcaacttcttctagcaagaagcagctggctgacttgcaatgaaatctccttagagttttatctttaaatcattgatctcaatggatatcttatacctgaaaatttgctgttttactaagggtgaagtaaattaaattccacaagagttagaaaataatttaatcagctggcaaaagctaaggatgaaagcaagttaatacaaatttcaattttcaaacaagattcaatacatgtatataatttatttggctagattcaatacatgtatataatttatttggctattacagggagagaaaacataattactaggtcttattaaaagtatgtctttcttcttttccctgtcatcctttcttccctttcttctttcatttttaaattcccttcccctcttcctcattccttcctcctttcttttcttcttccctcccttgatgttttccatttactcagaaaacatttagggagcaattaccacaagttagagtatacaccatatgccaaggatgcacccaaaatgtacaggtgataaagcagcagttcctgccctcagcaagttcatagcctaatagaatctgagttatgtaagggtgaaggccctacagtacattctctataatattgtagtaagaggaataatctcagatctcatgcatgcattccatgatttttctctttacttttgccactgtttttctacctgatattaatcttaatactataatcttatactactccttcaagcagctccgtgtgttttctataggcccaccaattattgccatgttctaataaggttttaaagaaaatatgtgaccctttagaacatcaccccacttccatgcctgtcttccatcctctgtataaagagcagagggtgtgaagaatggactagaagggttcctgggtggctcattgttgtgatctgtttgcctgctttggcatgctttgattataataaatatcttctctgaggggagcattttgaggaaagtgattgtaaaagaagatggaaatccatctataaagatggtaaccacaggaactaatttgaagaggtttttcatatttattaatagcatagaattgtccttccagaaagcataaagttctaaatttgaacaaagtccacagtctgaaccaaaattctgtacctttcagaatggatcataaaagaaaaaaagtctacagcacaaaaatagtttcctcctataacctcaaacaaatgtgagggcgatctgcccttgcaattttcattacttcaagataacaacaaggaaactatgattcagttagttctttcctttcacacattcagagttactctgcaattgctgagtgctagtgtatctatcctcaagtggcatttctgtttgagaactgtatttttcattatttagagttttctgtaatttttactggtaatattaatatttaacaatatcatacccccagaggtatctttgtgcaactttagaatatacgtactttgtttctttttatgactctaaccttttattctttcattcctctagtactctgaatataagagagtctacacgctttttagtgaggattttttgatccctgcttcataagtgtcactcattgtaggctttcctttgacaacaaaaattcctgctctctttacgttgactctaattacttcaccagaaaaggtaaacctgtcattgtgtaagaaaaggaattaagttaatgtaactgtttcttaaggtcttattattattttatttttatttttttgagacagagtcttgctgtgtggcccaggctggagtgcagtggcacaatctcggctcactgcaacctctgcctcctgggttcaagcgattctcctgcctcagcctcccgagtagctggaattataggcatgcaccaccacgcctggctaatttttctatttttagtagagatggggtttcaccatgttggccaggctggtcttgaactcccgacctcaggcgatccacccacctcagcctcccaaagtgctgggatgacaggcatgagccactgtgcctggctcttaagggcttaatgtgaatgttgcatacacatgtaatttctgattcatttgtggacctttgcgtaaaaataaaattttcttagaaattcatagaaaaacatggcagttcttaccatgcatcacagtcaatttcctgagggttctgttctttggagtctggggaggggaggtgctgtggtttggatgtgtttttttcccaccaaagcccatggtgaaattcaatcctcagtgtggcagtgtggggagatagggcctagtgagaggtgtctgggtcatagaggtatatccctcatgaatagattaatgccttcctgctagggtgagtgagttctagctctcaggggaatgggttagttcccttgaaagtgagaatgggttgttaaaaggagtctggcttccttggttttgctcttttgcttcctttctcagcctgtgatctctgcacactttggctctctgtcactttccaccatcagtagaagcagcatgaggccctcaccagacacagctgcctaagcttggggtttccaggatcatgagccaaataaacctcttttctttataaactacccgtctcaggtagtctgttctagcaacataaaacagactaagacagaggtcttcaataccaaaagatagtctacttgatgtgtgaagggaggctttggtttgcctgctataaaataattttagttgatgaacccgaagttccctgaaggtttagtttctggtgactttcattctgcaattcttgcacaaatggaaaaaaatccatcctagttgaatggagtacctacactacaaatgtagagtgaatctgtagaaaccactttttagataactgataaaccagctagttgctaatcacttcattgctgcttcccaccaccagtcaatgtttaaaaaaaataaagaattctccacctaactttgacaactggggaaaggtaggactttgtttcagcatcaaaaggaagtagagccacgtagaattatcatttagttccctcagtcatagccatttctcatttttcatcttccctacttttctcagggccatttattgtcctctaatgcctcccttctcttcattcttttttgctcttaatatctctggagggacaccaaagaagtgatttctttctgcattcattaaaaataggtttatgttttgccttcctgttcaattcccacttgggctgtaagcaagtaactaaagcaagggaagggttgggcatgtgggcgccagacttagatgcctctatttatgcctagattcttcctatttctcccattcttccctcaggataggagaaaaaggaggtggcagaggtctgattaaagcagggatgagcaactgagccaccactgcagtgctgagattgggtgaagcccccagcttcacagaaaggcctgcaacatcattgcaagattaaatgtgccaatattcttgctaagttactactttttgcacattaccagagaatagacttcccgggcctaaaggaatggcaatgttttcattgtcatttatttctctgttcagtaaggtagatagtacaggttttaagagtcttcttttttttcctcatgagactctatttcttttcccctctattttcttctatgctaaatggctgtatctactcttgaaaatacattctaactctaagtgtcctttgtggatttgactttaggaaaccaaagtagcttcccccaagccaccctctgtctctcttttttgtttttttgcccattggtcgattttaccttctttttgtataccatcaacccaaagacacagcatactagggacgtaagtgtggaactgataccgttagttttatttcggggtgatgcaatccctctgctaattcttagatggtcttatggtgtcagaagaaaatttccttctgtcagaaagccttaagtacgtttggaaaataattcagaatcaaggctgtcttcttctgttttttaatcaattcactaaatagtcttcatcatacagagaaattattccttctactccactccaaactaagacattattttgaaatagattatcaaataatagtgcagactaatttccatagctcaatgagtagaaggcaaagtacattatttgctaatgcaaatgctgagccttctccaaaaaatttaatattcaaagtccagacgggataaggagacaaaaaaagattgcttaacaattttccaaaccaaagtgacctataacacacaaaatatggttctattatgtgcaactgatattttctttgttgagaataatgagctacagcagaatggcataatgtagaactccacagctgataagctttctgcataagaacaggaagaggacatttcttaaagagttctgtgttcattgcttaccttgaggaggcagtgaatggaattactgttaatagtaacaatatgaagctaattggtttaaaatgaagcagcaggaaatgctgatgatgagactggggtatatgaaggaagaatgaaaaatctatactccggctacacaaaaatgatgcttaaaatgtaacttaatcttgatattttattcataaatgacaaatctgctcactacactgattccctaggtgactcatcaaatcccatctctaggtttatgaatctcaaaattttgtagctagttctgactgttttcactggcaaaatttgtcaaaatcaacttcttaagaatttggaaattaacccaaagtttgcaataatacaaaaagcatttacttttttaaaaaatggctgaatcccagtaaaaacagtgagctttgtggcattttaacttgcacttataaccatctgcctctccacagcttcacagtatccttgaaaatcaacagctttgcagccatgatagctatgaaaactagcagcctagcagccactggaggggacaggtcaggtatgaagctcccccaaaattcccattcccagagaatggtcactatttaacctgtctgaaagttccttaagaaagctccattcttatagtttgtctttatttgccttgacttaaagctcatttggtgggaatagccctgaccccagctaattttttgaaataatcagcaaaaaagctttcagaatagtgacactaattgaaactaaaaaaagaatgaccaaaaatttcacaggaaagactggataatgagatgtgtttaggggggtttgaaaagctctgatagatttctggtaatctagaaggccatgcacatatacagggctgtgcacgttcccagaaaagacctgagaagcccctattctctcatctctagttgactttgaggttctgtgcaagctggatgtgaaggctaaggcagagttgtaaactgcctggtagagcattgaagacacaccttaatacacacacatagtcctttggcagtggctgggagacttactggctcaaggcatttaaggaaatctgttcaatcattaggtaattggtaagctaactgagcacagacttctgtggatgcagtgagagataacacagaatttacagaattagtccaggaaagtcactaaacaaacagcagctgcaataataaagggcatcaacaacagaccttagagaggagggaggaatatgaattccagaattgccacactatattccttaaaatgtatagcattcaacaagaagttaggagacatgtaaataaaaagcaaagtatggcccatacacaggaaaaaaggaagtcaatagaaactgtccatggatgttggacttcctagacgaagactttaaaccatctatcataaatatgttcaagttactataggagacatgtctaaagaattaagggaaagtatgaaaataacgttttggcaaatagagaatgttaacaaaggatataaatgatttaaacgtacaaaatcggaattgtggagctgagcagtgtaatagctgtgataaaaatatagtggggctcaacagaagaaagaataagcaaacttgaataaaggccaattgagatgaataaatagaagaacagaggaaaaaagaatgaagaaaaacagtatcaaagacctgtgcagtgccatcaaatgtaacaacacatgcatagtgagagtcccagacagataagagaaaaaaaggggatgaagaatatttgaagaaataacagctgggaactctccaaacttgatgaaaactattaatccacacatgcaagaagcccagtgaactccaagtagggcaaactcaaagagatccttactttactacattacagccaaactttctacagctaaagacaaaaagagaatcttgagaatgccaagagaaaagtgactcattgagttcaagggatcctaaataacattaacagccagcttctcaacaaaaaccatgaaatccagaagaaaaaggaatgacctattcaaagtgccaagaattttacatccagcaaaaccaccagttaaaaacaaaggagaaattaagacatcctcagataaactgagggaatcttatcactagcagatcttgctccacagcagatagtaaggggaaaccttccgggggaaatgaaaggatgctggacagtaactcaaatccacatgaaaaaataaagagtaccagtacaagtaactgcatttgtaaatataaaagacaatataaacacatttttgcttgtaactctttctaatttaaaagacgaatgcaaagcaatgatgacaagctgtttgataggcttataatttataaatatatacttttttaattgaaatttttttcttttatcatccagcccaaaatgtcataaagatataatttctatgacaataataacacaaaggaggagaaagggaatgaagctatattgaagcagttttacatataattgacggtaaattggtattaatccaaactagattattttaagttaagatgttaattgtaatctctaaggcaaccactaagaaaataaagatatagtaagagaaacaagaaaattaaaatagtatactagaaaatttatatgttaaaaagaagaaaacctcaagtcaataactaaaacacacctcaaggcactggaaaaagaagagcaaattaaacctaaagcaagaagaagaaaggaaataataaaaataagagtagaaataaataatttagagaacagtaaaacaatagaggaaatcaacaaaaccaaaagtgtattctttgaaaagatcaagaaagttaaattaacaaatctttacctagactgaccaagaaaaaaaaaagactcgaatttcaaattattaaaattaggactgtaagaggggatattggctgtgcagaaataaaacaaaagattataagggaatgccatgaacaactgtatgccaacaaattaaataatcttggtgaactgaacaaatacctaaaaaaccacaaactgttgaaaccaactcaagaaaaattcaaaaatcttaatataacaaggatagagattggattcgtaattaaaaaaaaaaaacttcccacaaagagaagtctaggccaaaatggccttattaatgaattctaccaaatacttaaagaattaacaccaatttcataagttctaccaaaaaatagaaagggaaggaatacttctgaactgattctatgaggccagtatacactgacaccataatgagacaatgacatcacaagaaaataaaattaaagatcaatatatcttatgcatattgatgcaacaattctctagaaaatatcagcaatctgaatccagaaacatattaaaagaattataaccatgatcaagtgggatgcatcctgggaatgcaagatgtatttaacatacaaacataaatcataaatcaatgcaatactttaaattaatatataaaatgacaaaaattacgttatgagcacaatagatgcaggaatctcctttaacacagcccaatactcttttatgataaaaatcattcaacaaaccaggaaaaaaacacagaacttcctcaatctgataaagcccagccatatatagaacccatacggctaaaataatacttaatggcgaaagaccagatgtttttccctttcccaagacaaagctagctactctggtcacttctattcaatatagtattgggggtgctagccaggctaattaggcaagaaaaagaaatcaatgcatctagcttgaaaaggaagaagtgaaactatctctatttgcagattacgtgatcgttatatagaaaaccctaatacacacacacacacacacacacacacacacaagttcagcgaggtttcctgatacaagatcaatacacaagcattagttgtatttctgtgtattgacaatgaacaatttggaagtgaaattaagacaaaaattccttatagaatagtatcaaaaagaaaatgcctagtaatagatttaaaaaagaaatgcaatactttcacactgaaaactaaaatatcattgcaagaagttaaagaaaaactaaataaatggaaagaaaactcatgttcatgtatcagaagactgaatacgtgaagatggtaatactcccccaaattgatctacagattcaatccaatacctattagtatctcagctgccttatttgtagaaattaatgagctgatcctaaaattcacatggaaatgcaaaggacccaagatagccacaaaaatcttgagtaagaagaacaaagatgaagaactcatacttcctgatttcaaaacctgatacaaagctacagttatcaagacagtataaagcataagaacagtattggtataaggagagacatataaatcaatgaaaataatttatattttcagtagttcagtagcaggcttttacagggttaactgattttcagtaagagtgccaaggtaatccaatggaggggaaacaggctcttcaacaaaagttctggacaactgaatatccacattcaaaggaatgaagttgtaccagctcacatgattcacaaaaattaactcaaaatgaatcataggcctaaatgaaaatgctaacactataaaactcagaagaaaacatagaagaaaatcttcagaatcttggatcaggcatgacttcttagcaatgacactgaaagcacaagtgacacaagaaaaaatatataatggacatcatcaaaattaaaaactttttgtgattcaaatgatattatgaagaaagtaaaaatacaatccacaaaaatggagaaaatatttgtaaatcaaatatctgataagggttttctattccaggtatataattaattgttatagctcaacaataaaagataagtgacccaattttaaaatgggcaaaagatttgaatagacatttctccaaaaaatatatgcaaataaccaataaacacatgaaaagttacacagcctcactagtcatcagggaaatgcaaataaaaaccacaatgaaataccacttcattcctactaagatggctaaaataaaaaagaccataacaaatgctgacaaaggtgtggagaaattgtaactctcatatgttactggtgggattataaaatggtgaagccactttggaaaacagttcagcagttcctcagaaagttaaatttagagttaccatatgatccagcaattccactcctaggtatacacccaagagaattgaaaacatatgtggatacaaaatttgtacataaatgtttctagcagcattattaaaaatagccccaaagtctaaacaattcaaatgtccatgaaatgatgaatggatacataactgtggtgtatctatatgatgggataaaaatttgtcaataaaatgaagtacttatacatactataatctggtgaaccttgaaaacactctaattgaaaaaaactaatgaaaaaaagaccacatattgtacgattctgtttatatgaaatgtccagtgtaggggctggggaaagtgggggcggggtagtgactgctcatggttatggggtgtcttttggggatggtgagaatgttctaaagttaagacagttgtgatggtcacacaactctgtgagtacacgaaaaccactgaattgtacatattaaaggagcaaatttaatggtgtgtgaattatatctcaataaaaaataatgtggtgtaaatctggccactcatggttttcacctcccttttttttttctcccctattgggacaattcataagttaccatgctgctggcagctctggcagaaaatgatggtgacagaaaatgacatttcaggaatggcttttaaggcacgaggagcaatagcctgaggataatcagagttgttaggctactctcctgtcctggaaagtgaaatcaacctgattctgtccatcatggacactggtgacttgagttgttgacgaatgttctgtaaagtttaatatcccctgctacactttaaatacagagcccaatccaccatatctttcaaactcaggctatttcaaacataactgaagtagaacttcaaattagagaaacttgaggccttctgatcactggccagaggggaaaaattgttttttatgacctgaaaatgtatttagtatgaaaagaaaatgacttcttaagatgagaataagaaaggggggaaataaccaaatttgaagttctaggtaaatacaataaggcaactgaatagacactcctttctcctgttttctattaggattataattggggattctatctccatccaatagtgtttctgtacacttcaaaggtaggctaactatttaaaccagagacagaacactctgtattactctttttatattgatgtcctgttacaaccatgttttgtttcgttttgtactagagaaaaaagaggactcaaacttatgttgtcaaatatttcctagacacttttgtgtgtgacaggaaggaaacttgttaatactgctgtctcaggtaatactgcttttttagttaatactgcccttcatccctgtgtttaccccctcgagcttatcctccctgttatctgattggtttgtcaacattctgaaccaaaactctattttttaatggaaagcctaaggaggcactttttcctgaaagagattggtgtccctgattatacttactcagagccttctctggattactgggaaggaacacacctgtgcatttgatcttaacaagctctaaatctatattgtgttgctcaggggttgcctgacagagctcagtcccatggtggaagaaacctaccaacctcggtcttctcagctttcaaaggcgacacctgcctctggcctctctctgcattctccccattatgatgtggttctccagaccagggaagagaccagggggaaacacaaactaacacaacaagctccttctggttctgtgtgtagctctttgcaatttccctgctctggtaggcagcactttccaatcagccctgcagctccacctctgagaattcttcatgaggaacaagctttctttagtcatagtcacttgtataagaagagatgttttccttcatgagttgtttgaaatgcagtacagtcattccttgtgttctgaaaagctcccactaaatgacatcatttaattccaggatgctcagaatacttaataatacctttggttttgtctttgcaaaacaagttttgtgtttgtggaagggaacaaatctgaggagtggcaagcggcgaagaccaaaagcttatctgtgtggaattgctgctgtagacaagaacaatataatcctccctgttctgtacctactaaatcttacaaagggttagaaaaatagtatttcatctgtctttgggtttttgataataccaaataacatcaaatggaagcagtctcatggtttcttcattgctaaactaattgttattacatacttgttcctgtgtgatgttaatatatattcctggaaccagaaaggtctacatggtcaaataaatttgaaacttgcattaaataagaataaattgatttttttctccttcagggtttcacagaatctttaataccaatgtgcttttttgaacctcttaatgcagctctggtaggctgactttctgtgtgtgtgtgattattttatttactgccaatctccttaaagttagtttttatttaaaaattatttgtataaacacctgaactatttgactttttaaaaattccattctattgtgttaatagcacttaacatgcgatctacctctgtaaaccatttttaagtgtacattattgttgactgtaaggacaatgtggcacagtagacctctagagcatatttatcttggttgactgaaactttatggctgttgattagtaactccccatttagtaactccccaattagtaactctccctagccctggaaaccacaattgcactctttgattctatgagtttgacaatttcagatgccttacacaagtagcattatgtagtatttgaatttctgcgactaacttacttcacttagcataatgtcctcaaggttcatctgtgttgtcacatattgcagagtttccttctttttaaagactgaatagtattccattgtatgcaactgtgtatgcatacaccacattttctttatccatttgttgatggatatttaggttgtttctatgtcttggctgtagtgaatagtgctgctgtgaatataagagtgctaatacctctttagatcctgatttcaattttggtgggggatacatacccagaagtagattgctggatcatgtggtagacatatgtttgttttttttaagaaacatctatactgcttttcatagcagctataccattttacgttcccaccaacagtgtggagcggtctcaatttctccacattcttgacatttggtgtctttttaaaaaaataatactcatccagacaggtgtgaggtgagctctcatagtgcttttgacttgcatttccctgatgattagtgatgttaagtattttctcatatacctgttgtcatttgcatgtcctctttggagaaatgtctattcaagtccttagcccattaaaaaaaatcatgttactaggtttttttttcttttttactattgagtagtaggaattccttgtataggttggagaataacctcgtatctgatatatggtttgcaaatattttgtcccattcagtaagttgccttttcactcagttgactgtttcttttgttgtgcatgaactttttattttgatgtagtcctacttatttttgtttttgttccctgtgccttttgtgtcatacccatgaaatcatggccaagacgactgtcaagtggtttttcatgtatgttttcttctagcaggtttacagtttcagatctttaaatgtaaaataataatattgaattgatattttgtgtatgccataaggtccagtttcattgctttgtatgtcacgtccagtcttctcaatatcattagttgaagagactatcctttcccattgtgtattcttggcaccgtttgtgatgaccagttgaccatgtatgcatggatttatttctgggctctttattctactccattagcctatatgtctgtttttatgccagtatcatactattttgattactgtggctttgtgatatatattgaaataggacgtgtgaggcctccagcttttttcttctttctcaagattgacttggctaagaattttagcattttgtctatttatgtaaaaaaatgccattggaactttgataggaattgcatttaatctgtagattgctttgagaagtatgaacatttcaataatattagatcttccaatccatgaacatttgatatcttttcatttgtttgtttcttgttttatttctttttactatattttgtagttttcagtctgctttcaacttcttagttgagtttatttctagatattttatttttttggtgctattgtaaatagaatttttttcctaatttcttttttcagatagttcattgttagtgtatagaaatgcaagtaatttttatatattgatttggtatatatcaatatataccaactttactgaattcattttttagttctaacagttttttttttaaatggagtctttagaattttcaaatatataagatcatgtcatctgcaaacaatgtggacaatttcacttcttccctttcaatttgggcaccttttttccttgcctgactgctctggctaggactcccagtattatgttgaatagaagtggcaagagtaggcattcttgccttgactctaatcttagagaaaaagctttcagtttttcatcattgagtatgaggttggctgtgggctaaccacatatcaccttaattataatatgttgaagtaatttctttctgtttctagtttgttgagagtttttatcatcaaaggatgttgaattttgtcaattgatttttcagcatctattgagatgatcatatgatttttatcttttattctgttaatgtggtgctaattggttttcatatgttgagccatccttgaattctacagataaatcccacttggttatggtgtatgatccttttaatgtgcttttagattcagctttctagtattttgttgaagatttctgcatctatgcatatcagggatattggctgcagttttctcttcttttgtactgtctttatctggctttggtatcagcataatgctggtctcataaaataaatttggaagtattcttccctcttcaagtttttggaagagtttgagaaagatcgacattaattcttctttaaatgtttggtagaactcaccagtgaagtaatttggtcctgggattttctttgttaggaggtttttatgatagacagtcttgcctcttgaatgaatatttatatctcaagaagctagtgttctgtgaaagtttgtgaatgaagttttagattcataccctttaacctaatgtaataattaagagaggagactttggacaaaaagtactggattctatttgtgggtctctaccaattaacttcatttacagaattagcatagtaatacttgctacaaatcgagttgtgaaaatttagtgaaatatatgtatactaacaaacaaaaccccaggcacttaggtggccttaaataaatggtagctattattgtgtataaaaaagttagtttagtcaacaccttttccagcaagaagcaagaatttctttcgtttataataataatttaataaaatttcctaaaatgccttctgcatgatgcaagaatgatgaaattatatgcaatgttcagttcgattttagtggttagcacaatttatggtattttattgtttaggaaagggagagtaaagaacatctattgagagtttatttagtactcataccagtcttagggagtaaaaattatctaaccccacttcactgatgagtatgcttcagtaaattgctaaagttcatggaaagcatattctgtggcaatgttagaattcaaacccaggtcccctgactccaaagccaatgctgtctccatactgccataccaccttctttaaaaatgaacaatttggctgggcatggtggctcatgcctgtaatcccagcactttgggaggctgaggtgggcggatcatgaggtcaagaggttgagaccatcctggccaacatgttgaaacctcgtctctactaaaaatacaaaaattagccgggcgtggtggcagttgcctgtaatcccagctactcaggaggctgaggcaggagaatcacttgaacccaggaggtggaggttgcagtgagccgagatcgcaccactgcactccagcctggtgacagagtgagactctgttaaaaaaaaaaagaacaattaattcttgtgtgtacataatagctctctgttaactaaggctattctattcttcacttgtttcaaataaatatctcccctactagatctcaatacagtggtcttaagtcaatttaatcccagtaatgttttatagtcattttctcagaatttctctcatgttcaggtaaggattacataattgaacacaaaattttatcttgtctaagtacttctgacttcacagggaattgtgataaggagtataactcagtggagatgatgtgggatggtaggtggaatgctggccgtggccttagtagtgatcttagtccttcccctgctttaagtccctgtgtgacccagtgagttactctgtatctttaggtcttagttttcttactatttgctctatctacctcatgggagttctgtgaagagtagattaactcacttttccaactctccctatctgtagttgtctcaaagtggagaatgcatactccagggatgagcaggatggttcattcgggtagaggaggatgacatcaaggaacacttataggtgctttaaaatttgttcttttaaaatttacgtttttagcatatgttttataatgtatggacatagcattacatttatgaaaaccataaacacacaaacatatattggagatatgtgctttttttttaattaataggggtaggtgataaaaatgtcgagggcctggtggcctccaggataaagtccaaattctttagtatggcatttatgtcctctggggaccctccagcttcatttcctcccccattgcttctccttctacttaatgaactgaacatactagtatgttttgtagcttcactgtctttgcttatactactctttttgccagagactcctgaaacctctctcagcctcccaccttccacttgaaagactaatttctcaagactcagcaaaggagttatctcctgaataagccctttcctgaacctctcaggtatgccagatcactccttccttgggcttccactgtactgtacacatgccacctataagctgtgtggaagtgtgcttgtttgatttcatttactagtctgtagatctctgtattactctacactgctataaagatactatctgaaactgggcaatttatgaagaaaagaggtttaattgactcaaagttccaaatggctggggaggcctcaggaaatgtacaatcacagtggaaggtgaagcagaagcaaggcacatcttacatggcagcaggagagagagagagagagagtgcaggggaaactggcaattttaaaccatcagatcttgtgagaactccctcacgatcactagagcagcatgggggaaactgcccccatgatccaatcacctcttaccaggttcttcccttgacatgtggggattacaattcgagatgatatttgggtggggacacagagccaaaccatattaagggcaactgccatggcttcttaaatcttttttgttttagaacctaaaatggtccctggtatgtatttcataaatattgattagctatgcaaatagcaaataagctctgagagtactatagcatgttaaaatctccaggcaaatgttaatagttattattattaacctacgttaaattctcataggtttcagtggaatatctttattaaaaatcttaatcaagtgacgtgagcaaaacaatcctaattgacacctgtagacactggttttcaaccccgggagctttcaaaaatatcagtgcccaggctctgctcataggggttttgattcaattggtatgggatatgggtcaggcatctgtggtttttaaaagctccccagatgattttcatgtgcaggcagggctgagaaccattgtttcaaatgtcatggataggaaaagaaaggtgcttgggaaaacctaaggcagagtgctcttcctgaaaatgcaactgcagttgtgaaagcttctgtctttgtaaggttaagatgtgtccttgggggaagacacacacacacaaattgcagttatttattgagaccagactactaagtcacttcgatgaaaacttgagagcttaagactcgccagcatgggctaagaatagatcacattgcagaaaccagaacagtttcttggaaggaatggctgaagacattgacaaaggctgagcagaggatgaaattgggaagtcacccatcaactatgggggttgggcaacgtgaaaatgtgcttaccatttgcaatgaaatggaaaaggccttggtgagaaggcagtggagattaatgataataagtcatgttgagttttaacaagataacatacaggataacaaaaaggcaaaagtttattaagtcagatcctgattttgcaactaacaccttttttcctccctctctttttcaccttgagactgttacagatagctgagtaaggtgccaaattagactcgaactgcatctcagggtgaaaactgtgagtgagcatcagctaatgttatcctaaagtgtatggaattacaagtttctatgaagatgtttttgagaaaccttattaggattagtgcgtatgttgtcaacattggattttctagagaatcagagtgaatatagctggtacataagcattgttaatttgcatcatggatatcaaagccttcttgatagaaattacctatttgcactgcatactaatttgggcattgctgctctggaattgataaaagtttagcctataaattggctgaagttccttttgtgctaagaaagaatttgctaagcagatgcataatgtgccattggccattgcggttaatttttttaagagaataaatatttccaagcacttaagtgccatgtgttacaaatcacaccactcagggactagttgaggcttcttttttccttgaagtcgggcaggcaggacctctagtggcaatggctagttagcagttagatttagtgctaatgttttagaaagtacaaactgcacttcttttaaattctggttgatagacttcaggttgatattccccccaataatttaagctttgcacattctaattccctggtgttcaaattgtcacaagttcttgctgtgtacatatttcttggaggaacacttttaaagaaaatggcttcaaagattcccaggcaaagtggacacctggacctgtaaaaggaacgctgcccctaagatgtggaaagaggccaacaaatgttttaattggttcttgacttcagtactactgactttttctcacatggcacactgatgcccctaaatacccatttgtcctctgaatttggtctttcaaacaagggtgagagatgattttgagagtgagaagagagctgttctactggggaaaagggcacagggagggagttttgacaggtatttgtggtggccacagccagtgataaagcaaacactgcagctgagttcaggccccactgtgaacgggcctgcagttacatctcactcctctcttctgtcagttgggtcccatggggtccactggcaggacccactccaggcaggtgtccctgagcctctcctaaccacctctttctcctccatgtctttgctctctatgtggcgggggcaagaggggagcaaagggcagtagtggcttgtgtgcaggcagccagatgggagcctgaccttgggtcacaggcacacgaaaggcacagcctactgatgcactatttggcctgtgctgtgaggaggggggtgcagagggagagaggaagagagaagaaaactcctttcttctatctctaacctaggcatctagtgcatttcagtcctgaattctttcagggctcagctgaaactgttacttcagaacccttccctgatcaaggtcaggccttccacgggctttttgtagcttcctgtgcttgtctctaccagcacttattattattaccatgaattacttgtgtaaatatttattatctgtgtcagtggatgataagcttcatgagagcagagattggtgtctgtactatttatttttgtattcttatgcaggaggcctgagacaaagtgctaaataaatatttgttgaatgagtgagtgaggcaacaaatgaatcaatgagatacacaagaacatatgtataagaatgttctttggaaataacctagagtctagcaagagggaaacaaatcatggagatccatttgtttgaatatgtcattgaaaggcatatctcaaaaaatatttactaacattgaaaaattctcagaatgtaaggttaagagaaaaaagtagggacacaaaaattgacatatggtatgattcctttttctttttttgacataaagaaaatacagagaattcttactattcatggtagttatattctataaggtcactacaaacactgaattgcaaatactgaatgattgcacctaggggaaatacagagttaggctcctgcaagcctctggtcacaatatttttgtcaactgatcaatttataaccttgttttatatgtgtttctgtttaaagacaccttcttttaatatatattattgattacttaacattgaaatcatgaccaacagcactgtcacttatgcctgaaagaagcttatctaataacacacgtattttctcaagacacatcacagtcttgctatgctttggacaccagacagtgcttcagctccatgctgcaggcgattttaaaccacaagaccactaacaaaaagcatataaatatgaaaaatatagcactaagtagatcttagaaaagatacttgtttacagtatgagagctgaaacaagaaggagaggcatcaccttgtttgacttcgcctgggcatgtatgcatcagccaactcaacctttttgctgctctgagcatgtgcatgcccacaaataactgaaatgcactgtgagtattgatttgcggttacaattcaattttagcaagtaggggaatttgcaaatacaaaatctgtgactaatgaagattgactgtatgtccttaaaacaaaaaaaatctcagggcaaatctgcccctcgtggtagcgggactatggtgacataaacatttaaagatgtatccttttctttaattcctcaaatttctaaaattaacttgtattattgtataagtaggaaaataaatattatttttcttttattaggaaatggcaaaatgtgatgggcagaatatatatagagaaagggtagcaaaaatttctttggccagctgtggcacagtaagtttaaacgtaaacagccaaaactgtcagtagagtagtttcaaaaacatattgagccataactttgaaatatattttgagccgggcacagtggctcacgcctgtaatcccagaactttgggaggctgaggcgggtagattgcaaggtcaagagtttgagactagcctggccaacatggtgaaacctcacctctatcaaaaatacaaaaattagccgggcatggtggtatgtgcctgtaatcccagctactcggaaggctgagacaggagaatcacttgaacccaggaggcagaggttgcagtgagctgagatcgcgccactgtactccagcctgggtgacagagtgagaccctgtcttggtgggaggtgggggagcggggggagggggaagaaaaaaagaaagatattttgaattctctcttatatgacttttgtgaatggccaaagtatcattctgtagtcaggaacaggctgactttttgagccagggcttcaagctgaacaggagaaagagacataagcatgaacaagacctatctctgcaagcagaggtcagccacttgacaaaggcagtgcaaaggggatggctttctccggaaatccctcgcttcagctactcatcctccacctcctgccaagtctaggttaggttcccctcagcagaatgtccttctctgttctagcactccccacactgtgttgtcattacctgtatatgtctgtgttcccaactagactttaagctctatgagggcaagggctgaatgtagcttgctcactattgaattacattgcctgacacattgctttgcacgcagtgagggtgaagtaaatatttgttcaatatataacggaatgattatgcatcaaacaccccaactgatagcgactcctgtgagaatcgtcctctttaaatataagtcggtgtcagaaacaacgccaaacctcaaaaaagaatattgaagagttcaaatgagaaaattcaaacaccccaacagacagtgcctcctgtcagaatcgtcctctttaaatacgaagctcagtgtcggaaacaacaccaaatacaagaatagtgaggagttcaaatgagaaaatttcagtcttaaaaaatagacaagatttcatatactcaggcaaaaagagatagaaataagaatctgcctacgtgtgaaaggcaaatacaattcctgtttcctttatcttcttacgattgtacaccctgttcaaccatctttgggcttgtgattactgggtagtacactgctatttcttgaagtgtccataaacacagatagcagagctcaattcctgaaatgtgctcctgtttgataaggtggattggactggatcttgttcagcctttaatctacttccttaagcatctgaggatgttccaaactcaaggctatttcagtacctttgtatttgcaatgtatgatgctttaaaatgataactgtattaactttctatggcctttataacaaattgctgcaaacctaatggcttaaaacattgtaaatttattatcttatagttctatttatcagatatttgcccagatcttactggacaaagattaaggtgttggcagggtacattctcttctggaggctctaggagagagtccatttccttgcatgtttcatctgtagaaggggggctgctttcattgtcttgtgcccaccttcctccatcttcaagaccatcaggctgagttcttcccatgctaccatctctctggttccctcttttcattcccccttccactttcaaagacctttgtgtgattaagcccagcaaaataatccagaataaaaaatcttattttaaggccaaccgtttggcaaccttaattccatctgcaactttaacccacctttgccgtctaccctaatatattcacaaattctggggagtgggatgtagacatctttgggagttgatatagtttggatgtttgactactccaaatctcatgttgaaatgtaatctccagcgttgcaggtaggacctcctgggaggtgttgggttattggggtggatccctcgtgaatggcttagcgccatccccttggtgatgaatgagttctcagtctattagttcacacaaatgggggttgtttaaaagagcctgggctgggcacggtggctcatgcctgtaattccagcactctgggaggccgaggcggttggaacaactgaggtcaggaatttgagaccagcctggccaacatggtgaaactccatctctactacaaatacaaaaactagctgggtgtgggggcacgtgcctgtaatcccagctactggggaggctgaggcaggagaatcgcttgaacccgggaggcagaggttgcagtgagctgagatcacaccattgcactccagcctgggtgacaagagcgaaactccacctcacaaaaaaaaaaaaaaaaaaagcctagcatctctcttgccacatgacacgctggctccttttcaccttctgccatgattgaaagcttcctgaggccctcaccagaagcagatgctggcgccatgcttcctgtatagctttagaaccataagccaaaataaatctcttttcttaataagttactcagcctcaggcattcctttagagcaatgcaaatggaagaacacaggggcaattgctctgcctaccaaaataaatgtacacactattatatatgcatacaaactaggaaatatagtcatttatatttatcaggattcaaaatatcatgtccctatcccaactgtctactgtctgtcccctcactgcccctgaaaaaaagaaaaatatcctaagatgcaaacactcaaaccatggaatgaaatactcttggagataaaaaagtcaaatacttctcttgctatgcggatttaagagaaacatctccacagtatcagttgtgtgggagtttatgtgtaggaatctaactgctcatgagttatctccatgaagtcccgctcacagtatgaatagatgggatcctgttataatctgcttactgtttgccttgcagttgtgcatataaattatgtctaaacccttttcttcttaatcattcttctttcagaaattttgtttatctttctaatttgattagacaaggctctcctatcccccactgcttttttaacagcacagagatagcaggaggattgatcagtgactggagatccacaggggtgataagcttttctgtatatttatgtagaaggcaaaacacagcagaatgagaaatatcagattccagatttcatgtcccatatgtccccatccaaccctgtatcatgcattaaacaaataaaaagtaacagaagggcccagcatgttggcttctgcctataatcccagtactttgggagatcgagatgggcagatcacttgagctcaggagttcgagaccagcctcggcaacatggtgaaaccccatctctacaaaaatacaaaaattaggcgggcgtagtggtgtgcacctgttgccccagctacttgggaggctgaggtagaaggattgcctgagcccggaaggtggagtttgcagtgagctgagattgtgtcaatgcacaccagcctgggcagcagagccagaccctgtctcaacaaacaaacaaaaaaaaaaaaaaaaaaaaaaaaaaaaagggagagagagagaggaaataagtaacagaactagcagcatttcatattccagctaccttttccccatttacaaactcctgagtctgaaacatttgttatatttggttttgagtgaaaccagaatcaataacaaatttgttttgcattcattcctcaatatatttactgcgtgaatatggatcagcagggatggtgtgagactgccacactcaagctgggcgtttgtgcaatccacatcaacacttccaatactctcaagcaaggccaataaatcataaagctcatgtgctactgaattcagcacttcaccatcggcaaaatcaatggagatgcttccagaattttcagttttacagcttcttgaacaaatcttttcccctagtccctctctttgtctgtctggctaaggttgaggcatggacactgggtttgcctcctctccatccaccttctccatccccttttgagaaatgaccacgtggttgaggtcgatcttgtagtcaagccaattgtggtttttccatccctattcccagtgaggcaacttgttgcatgtcattcccctggcaaccaagactggttcagtttgggttgattcgatgctagcagaagttttttggggcttctaggtaaagcgtcctcatccttaagtgaaagtctcaaagagtcatctttccccatcccaaactgattctagaacttctgcaggcatcttattatagatctgatgaagtaactgtcctagaagaatcacagggaggtggagctccttccctatccctgcactcacctctccagttatgcaggaatatatgcattattcttttgtttgtttaatcctgtttgagttggagttttttgttatatttcctcattcattcaacaaataattacaactgtctgctgtgtacaggcactgctttaagcaatgtggattaaaagaacaaaaagggttcctgccttccagtaggaagagtttaaaaagcaaataataaatctaataaatcaggaaactcaacaagaacaagataaagaactagagagtgacaggagctattgggggaaagatgagagcagctgactaattttaaatagggtggtcaggtttcacctcattgaaaaatgtgatttggctcacacttggaatcccagcactttgggaggctgaggcaggaggattgcttgagcctaggagttcaagaccagcctgggaaacatagcgataccttatctctactgaaaaaagcaaaaaagaaagtacaggcatggtggcacacacctgtagtcctagctactcaggaggctgaggcaggaggaccacttgagcccaggagttcgagacggcagtgagctatgattgagccactgcactccagcctgggtgacaaagcaagatcttttctcaaaaaaaaaaaaaaaaaaaaaaaaaaaagtgtgttttgagtagacttttgagtgaatgagcatttgtggatatttggagaagagttttctaggcagaggatactgccaacacaaattccctaagttggaagcttgcttgggaatgtgagaggagaaaggagtggtgggagtgaagtgagggagggcaggggttaacagggagccctgtgggtcttttagcccagtgcagaagcattttgtttggctttgactctgattcaaatggggaaccacagaaggcttttgagtagagtgaaaaagatcactctagctactgtgttgggaaaggattttggagcagtaaaggaaggtgcagggagctgacttagaaggccacagtcccatgccaggctggagatgctgcagcagtggtccagggttgtagtgatgaaggtggtgagcagtggtttggattctggatatgttctgaaggcagagccaacaggatttcctgagtataggggaatgtgggagaaaagcaaggagtcaaggatgactccagctgaaagcaacctaaatcattaactctcaaatttacctgacttgattatcagctatttacaactcatgaatgttacataccatggagaagtccaacccaaacacagggttcacacgcaaaccagtaatttgatattgagggctctacatgttccattaatcacatccccctacttaaaatattttccttggctgccttttaagaataaagttattttccatagtctttgagagttaactcaggtaggaccgaagtgatgaccgttctgtcctctgcagcaacgccattgccctttatccttgttgtgatgtggttttcctgtgtcttctgctgctagatgtgatgacgatatccctcctttgttgatggactcagcatctgtacatgggatattttgactccaattttcctgatgcatcatcctaattgtctggtagttactgactgtcacttaccaaccggtgtgagatattcttcagctcttcatcaggaacagaattacagcctctatctttagaaatgatatatgctgaggattattcatgtttgtaattacaaatctagcagaagtgcaattattaaaaaaaaaacccttggaaaggacattttgttgtataacgcagaacctgctgttagcctcttgtgctggtattacttttgttgctgtaattgccacctgcatttcagttgtaatttaacattatctgtcttctctgtatctttctacctgattgtaattgttaggactcctgccatttattcttaaatactttcttgtctttctgaattactgggctattttctatgattataacctaagaaacagctgcagcaacccttgttgcattgtaaaaacttcagagggctggtttatctctagtttaaaaccagtgaagcaaacagtggggggaccttcggaggtcattcacataaaaccatcattttaagaatgaagaaactgaagcttttgagtgattaactaagttgctcatgatcatttacattcttattgttatgctgtactctggagtagcaagtatggatatatattcagagataggatcttttaagtcctagcactttgcaatttatgctgattaaccaacgacctgccaaacagagctcaagatgggaagggaagcgacactaaatcctttttttgagccagatactgctaggtgctttgtatcatggaccacattgatatgcacaataatctgatgaggtaggaataattatgccaatttctctctctctctctctctctctgtctctcacacacccacacccccccccacacacacacatgctgggatttttgggagattaagcaacaggctcaagagcacacgggtagtaactctcaaatagtaagaactgcttgactttccaccctttctctttctaccaaatcaggaacagaataatggatatcttccaaaggggtgagatatgagcatgagctactttttttttttttttttttttttgagatggagtcttgctctgtcgcccaggctggagtgcagtggcgtgatctcggctcactgcaacctccctctcctgggttcaagggattctcctgcctcagcctcccaagtagctgggactacaggcacgtgccaacacacccagctaattttttgtatttttagtagagtcagggtttcactgtgttagccaggacggtctcgatctcctgacctcgtgatctgcccgccttggcctcccaaagtgctgggattacaggcacgagccaccgcacacggccaggtatgagctacttttaaggcagttggaagcccaaagagcttgggaaaccatgaagactaggcctcacaactgcagttttctcaggcctatgcagctgcctccatccttttgctctgagcaaaactggacctagttaagcaatgttgcccaactgttaaaaaaggaagctcaaaactaggaggtaggatgccagataatttgtttaaatttttgatctttaaaatcttgactctttgagcttgttttgagcctcattggtccaaagtggctcaatctgactgaggaaggggttggaggaggaaggaatgtaaaaatgaaagatcggtgggaaaaggatactgccttaggttgtctgtaggtaaataaaggtttgactctataaaaactctcttcctgaaataatcaagaatgcttcacatcagaagcatcaattaaatggctgccttctttttgttaattctttagtctttagctatttctgctgttgctgcagaggcagagagatggtgaaagaatcaacctcaggaaatagtatggaggtcaagggtcagctaagaggatctactgattttctgatctgcggagctttctgagtgagtctcccttgaattgcaggagggcatccaataggaaacccagtatgcaacaatctcaagagatagcctctagaacactgggattagcattaatccatgaaaatgaggtgctataatgatgatgatgatgagactagaacctatagttacatgcattgtgggaaaggtttgaattgaaaggctgaaggagggagtggttgtcttccaagagggtatgatggtcatgctgaatgaagaatgaagtgaaagaagtcagtgaagatgcattaagaccgtaggtcaggttcaagtagtaactcccaagggttcaaccacataatgacgcattgaaggatgtctattacaatcataagaaacagcaaagtggttgagtatagtggctcatgcctgtaatcccagcactttgggaggccaaggtgggcagatcacttgaggtcaggagttcgagaccagcctggccaacatggtgaaaccccatctctaccaaaaatacaaaaactagcagggcatggtggtgcccgcctgtaatcccagctacttaggaggctgaggcaggagaataacttgaacctgggaggcggatgttgcagtgagttgagattgtgtcactgcactccagcctgggtaacagagtgagactctgtctcaaagaaaagaaagaagaaaagaaacagcagagtgtcccatctgtcctgcgagtcctaaggaaactgattaatggcttcaaaagtttatttctcatcaaaatgaacttgattaattacaaatccagattttttagtcctgccccccaaaagtctgattttaccaatgaaaataacccccaggtaattcctgcaagcagcctcactggaaacatctggggtaggtgaccccaacttctgtcattgtgagtttctgtgtgctacctttcttttttggtttttgtttttaataaacagggtgttgctctcttgcccaagctacggtgcagtggtgcaattatagctcacttcagccttaaactcctgggttcaaggaatcctcctgcattgctgggattacagatgtgagccactgtgtcaggctctctgtgtgttccttctaatagtacttctagaacatctcttatttttttcttttccagctcggagattcttaatttgagtttctggggctcaatgaatagggcccaggggatctacaacccccctgaaattacatgcagaatttcacatatatatgagctatgtgaagagtctcaaaggaatctgtggtttccaaagggtttagaacaattgctccaactgttctatttatctcctttctgccctgacccctggagctggttcacagctttttatcctggccagtcttcctggctttagtggacagtacatttgtctttgactttgaaactttacattaactatgagacatagcgtgaaactttggaaagagaggggatcacttctatgtttctattaaaattaatttcctttggaagaatatgcctgtgacagttttcatagaacactgctgtccccattttaatgagaaacaaaaaaattcatccacgtcaccaatattctattgtgtctcttttctcccagaagccgatctctttgctaaaccatcttcagcacagctccagttgaagtcctttgcttgtctgggtcctttgttgccctcccggtgttctgctgtccacagaatatagccctgactcggtagcctggcatctgtgccctttgcaatctgactacctcctgctgctctcctaattgttccatgttccaagctaactgtgctcctcgccattgcccaagccctgtctgtgccctcttccctctgggcctacaggggatgccctccctctcctctccatctgtcaccgtgtacccttgttcaaggccttcatcccatctctccgtcagccagaaatttcctcttctgtgaacatcaattgtacttggttcatacgggtcttatggcatttgttacatattgatttttgtttgattatgcatgatttgtgtttctcttttttcttattagattccaagacctttcatcacagggcctttgttgatttaactgtgtatctggtcaattgcctgtcacagtacctagcatacaaaaagccctcaataaaatctggtgaatgtatttaaaaacctagatagggctattttaattcagaaaaataaatctgtttgccttttttcctggtaatctaagttgggcagttgcacgagaactgcatataaactgcattcaactcttgataaattagaaaagtcatctgatggcttcattaaaatgtgggctttaaaattatttatgatttcatttttcataacatctttgtgagacttgtagtagtgtagtattccccccgtcttttggatggtgatttcactgaggtgagaggttaaagtgggtcattcaaggccacagagcaggcaggtaacaaaactggcactggaaccttggcctcctggggccacgttagcagagcgtagcattgactgcactaaggatggaatacaaatgtgcttacacattgtcaaatcctgtgggtcaaaaagtttgttttagtgaaagcatcacagataatgaagtatttgaaattttctcttttcaccttttggcatgcaggctcctctctctctgttccctaaataaggacacgtctgtaggtctgatcctcagccctgtctgtctgtgaccttctccagtatccaggaccctcggcgatcaatacctgcctcgtggtttcaatgatcatcactctgctgacttacctaacgtctttgcctatggtgatgacccctgcctgctctccacctcacatctcttgtggtttaccagaagtttccacttagaattctgccatcacttcaaaatccagatatctaaatccaaactcatcatctgctctctgaacaaacttactcctttctcaatctacatttttctaccataattctcctagtcatccaagttcaaaatcattgttatctttaacttcctttatttttttaagagacagcttctcatcccactgcccatgctggagtgaagtggtgcgatcatggctcactatagtttcaaactccggggctcaagtgatcctcctgcctcagcctcccaagtagctaggactacaagcacacatctctgcactcagctattttttttttttttgagacagaatctcactctgttgcccaggctggagtgcagtgctgtgatcttggctcactgcaacctctgcctcctgagttcaaacgattctcctgcctcagcctcctgagtagctgggattagaggtacctgctaccacacacaactaatttttgtatttgtagtagagatggggtttcaccatgttggccaggctggtcttgaactcctgatctcaagtgatccacccaccttggcctcccaaagtgctgggactacaggtgtgagccactgcgctaggcctaatttttaaatttttgtagaaatggggtcttatgttgaccaggctggtcttgaactcctagcttcaagtgatcctcctgtcttggcctcccaaaatgctgaaattacagaaatgagccactatgcctggcctgttattttcagctttttaattggctttgtcttattgatacttccttcaaaatgtttatcatgtccatttgagaatctagagtggtttttttttttttttttttttttttttttgccaaggattacctctttctctagagccctccacctcatgcacattcctttctttctattttcattaccacattgtgatctaggtcttctcttcctcttccttaaatttcactggtgttcattttgttacaggatgaaatccatagtcttcaacctggcatacaaaacctcccacaagctgactccagttgatctttccaactttctagtctaatacttgcctctggtaattttttttccaattcttctgttgactgtcctggaatgcatcttacatggccttgctttggtcctcagtttagttcttttattttccagtttactcctttggatacttctcatcttcaaggtccagctcatgtctcatctttttgatatgaccattcctaattatttaaatccatattctgaagttcttggcccttgttgtctacatctttgctgctcaaagtgtcattaaatgagcagcagcattgtcaccacctggaagatggttagaaatgaatcttggggctctgcctcagacctgctgaattcaaatctgcattttagcatgatccttgaagtgatgcatgaaacacttgtctgtcccatttagatacttagataatactcaatccaaacaccaacttatgtacttatctgcactcctcaagatccttgaaatctgcgaacctgttttatttttctttagtatctctgaaacacaatttcatggtaaagtaggtgcttactaaatagattttagtgtccttctctttctttttctatttaaaggaggaaaaaactcccaagactcctagaaagtgagcatgagctgctatagtttgaatgtaacctcttcaaaattcaggtattgccaatgagatactgttaagaagtgaagcctttaggatgcgattgagccattagggctcctcccttgcaaatggaacaaggtcagcaaaccaataggagtgctaaggtaaatgactgtagaacaaaatggtgtttatgtagcttgatggtacatgtaatttcacaattgcattttgtgtctgaaaaacatatgaggttttgctaagcttagtagagaaatgcctgctttgtggcaatgttgtccattagttaaccagagagaaatatgagaacagatgatgtcactatattcttccactagcctaggttcttaaaagctctaagactacaagtgttatagatgactccagcatgcactcatactgctacttaactttcttcatggaaatgtgtcttattctgtcaacagactaaaagaggggcaaggacatatattatataattttgtatatactcgataatgctcaggacatagagcttcagttccttccctccctccctccctcctgcccaccctccatttctttattcctgcctttcatcctttaagtgtttgttgagtgattgagatcaaatattgatatattgtatctatagaatagaatattctattctagtgctattatatatgctggggataaatcacgcattaaaatgaatgtccttctctttatggaacttgcattccagtggagcaaaaagataaacaaaatcataagaggaatttatacttagaggacgataagtactgcagaaaaagattagagaagagggcttggaattggggaggtatactttaaaataaaaagccagagaagaccacctttgagaacataatttaagaaaagacttgaaggaggtaaattatgtagctatctgagggaagaccttcccagagagtggaacagcaggtacagggctgaggtgggcatgaacagggaagagtaagaacggtcttttgggtttgaagtagaaggagcttgcaggagaatgacaggagagatgaggtcagatattacatctcaataggatctctctggctgcaatattgagaaaagccagaagggggacaaggtggaggtgggaagacgaattagaaggccactgcaataatacagacaggagatggtggtggcttagaccagggaggcagccgtggaagaggtgagaggcagttacattctgcatatattccgagagtacagccaacaggatttgctgaaagattgaatttggcatatgagagacagagaggcatccaggatccaggcatttaagatttttggcctaagcaactagaaagatgcagctgccatcaagtgagatgggggaaggctgcggtggagaagtcttttttagggaagattaggaacttagctttggcaatgttgagtttgacatatcttttagacaagtggagatattgaggaggcagttgaatattggtggaatgaacgaataaccaggatcttaatcaagtgtttaactcccttaaacataaatcaactttttgtctacttcctcataatgtgaagcactttgggatgtgacattggaaatcagactcttctgaccaaggcccaggtctgcctgaattccaggcctagagatctgacaatgtgctggccatcttcccttaaatgttctctagagccacaccatgtctaaaatggaacgcactctctttatcccaagcctggtctccctctttgtgactgtggtgagtgggcaccactaggcatgtaagctggcagtcacacttcattccttccatttcctcatctccatatctaattggtcaccaaatcttaccaaccccacttccaaaccatctctagaacccatctcccccctccgtcttcactgctgcttttttggatttatgctctcattgtctctcacctggattatatgtaaatcttctcctacctggtttcccagtctccaatcgatccttcacatagctcccagagtgattttctaaaatgtaaatgtggccatgttactcttctgcttaaaacatttccaaaggctttcttctgtccataaaacccaaaacttgagtttggcctgcaaggatcatcaagatctggctcctgcttatctcttagatttattatcccccccatcccccccgtcactcctatccattggccagattatactacctgtagttagttaacttattcattcaattttcagatataaataggatgcttcatatgttacaagcactatgctaagctgtgggggatacaaagctagacattgaaaaagcctgaaataaacctggttgtcttccttcctacttacttacagtcgtcatacagtaagctgtggggatacaatgctgcattgtacgcagacttggttcctgccctcatgaaagtatactttctcaatttccatgcctttgctctctgaaccccctgccttgaatttaccaccatctgctcctccctccatctcactgccatgtcctccttctcctaccagctacttaaagaataccatctcaacttttaagaatcagcttacatcattcccttgtattaagctctttactctatctccttttctcttctaaaaatgtttcctccctcaaaaggtatcattgaaaaacttaatagctctagaagtgaggatatctctaaatacattccaggttcagttcagaatattgttttatcttatactagaagatcatagctcaaggaatgggatttccttctttatcccaaaagggaaaaaagcctccttttcctggatttttcccatgctccttgggctccacaagtgggataagcaattgttaacttgctgcagagtgagtgaacccaattgcattggattcacacacagtggatgctccaggattttttttaaatatttatttatttatttatttatttatttatttatttatttatttatttattttgagacggagtctctctctgttgcccaggctggagtgcagtggcgtgatctcggttcactgcaagctccgcctcctgggttcacgccatgctcctgccttagccttctgagtagctgggactacaggtgcccaccaccacatccagttaatttttgtatttttagtagagacgggttttcaccatattggccaggatggtctcaaactcctgaccttgtgatccacctgcctgagcctcccaaagtgctgggattacaggcgtgagctgccatgcccggccttcaggatttttaaatagtaaagcgttaggggtggtgagctgattggtaggggtgctaggaaacttgtcttaaagctaagtttgcatagctagcttacaattttcacttagattaatatacatagatttatagtagcttgtgggggactgataaagatgtgggttaaagattccttttaaagccatcccttaatgctaccactgtacagaaagatggcagagtgactgcctttatagacacctgcccacacttcctaatctgccctcagttgcaactcctagagagtaggcacacagcttagggtggaaaatacatgaaaattcagtacttgtaaatagatgggaggtgggtaatgaggatgagcgacagaagaaaaaaccttctatatttgtctgttctcaccacctaaggggttcttcagaaaaccagtgagctttacgctcaggttgagaaatccttgttacagtcactttaattgcaatctctatttcttctctctttttctttctctctctgtgtctctacacctctccctcaccactttctggatatgcacacatatttacattcagatgattttagaaagctccattggggaataactataaattatgaatatgcaacagcactaaaaccaactattatagtcaaaaatcctgaaataaacctcctggttctcttccttcctacttacttacagtcagcacacagcaatatatcttagagtgaggctaaatggatatctgatactcactcgaatgtgataggcagtcaacaacccagttatcactgttgaagcattttaaggactacttccatgtcactctggctatgataaaaaccatagtctccaaattggtacagtaggatgaaccttccatgacgactggtagcatgtgtttgattacacatatgtatacatacatgtacacacaatacacatacctaaacattataaccagattagtatattccttttgcattgtactgaatactttaaaataatgtttcatcagtgattgtcagagttataaaatcatttgaatatattaataagctataaacattttaattttaaaggataaaatatgctgcacaaaagagccagtacagccactgcttatgtgtttaatttatttaaagagatgcctgttctgttattacttcaaatatagttatatctacatgtaagtgattttaatttgctacaacatttagatgtatcaatgagacatttcataaattaaaattgtatcacgtagggagactatcttgattatgaagctttattaggtgatgattataagtgccttgtttaataattataacagcttaatggctcctgtagttatactttataataaaaatttcacatttaataatatggaaagggatggtacacagtgaactgacaaaaaagtattgattctgaacctttaaattggattcctattgatctgatgtatgaatattttattggtgtaaatgttttcagggttgccagtttctattactgcatgttagcaattttactggctatgtataatggacaaattaaatgccaggatatgggcatatccagcaccccacactgattattttgattcacttatcactatacactactagggccttccctttctctgtcccatctctgttctggaaggtgagccacagacttcttctgtacatgcctcagatacatgacaagccagtgatgggtggtctggcttgttatctggtagaggctgggtgggcatgtgtctcttcctgctaaggcccacagccccttagctaagacttacacatttgctccaaggccagtcatttgggcccgagtacctaatggataataacaggggctctgggattaggtagagcaagatggctgaacaaaagcttcaaccaattgtcctccccacaggaacaccaaactgaacaactatgcacacaaaaaagcaccttcataagaaccaaaaatcagcttaggtaccagcttggccacagtggagtagagcaccaagcaggctcttggggtccctgattccaggcctagctcttagatggcatttctggacttgccctgggccagaacggagcccattgcccttctgggagagtcccagtcctgccagcattcatcacaagctgactgaagagctcttgtgccttgagtgaacactggtggtacccaggaagtactcaccatggacctagggtagtggtgatcacagggagagactcctctgtttgtggaaaggggagggaagagtagaagaactttgtgttgaggtatgtgttccagctcagccacaatcgagtaaggcaccaggtatattcctaaggtttctgactgtaggacctggctcctggatggcacctctggacccacccagggtttggggaattcactgccctgaagggaaggacacaagcctggctggctttgccacctgctgattgtagaaccctagggctatgagcaaagataagcaatagccaggcagtggttaccacaggtgttgggtgagacccaatgctgtgctgacttcaggtctgacctagcacagtcccaagggcaatggccacaagggtgcttgtgtgatcccacccacagttctaggcagctcagcacagagagagagagagagagatgccatttgtttgggagaaagtaagggaagagaacaagagcctatgtctggaaatccaaagaattcttccagatcttatccaagaccaccaagtacctctaagagaccgcaagagtcacagtgttactagactcgaggtgccccctaatgcagttatggctacagtgaccaaaaacttagatcacaacactcaagtccctttgaatacctggaaggcccttcccaagaagaatgggtacaaacgagcccagacttagaagactacaataaatatctagctcttcaatgcccagatactgacaaacatccataagcatcaagaccatccaggaaaaataatcttaccaaacaaactaaataaatcaccagggaccaatcccagagagacagagatatgtaacctttcagacagagaattcaaaataactgttttgaggaaatgcaatgaaattcaagataacatagagaaggaattcagaattctatcagatacatttaacaaagagattggaataattaaaaagaatcaagcagaaattctggagttgaaaaatgcaattaacatactgaagaatgcatcagagtctcttagcagaattgatcaagtagaagaaagaattagtgagcttgatgacaggctatttgaaaatacacagtcggaggagacaaaagaaaaaaagaatgaataagaatgaaggatgcctccaagatgtggaaaatatcctcaaaagggcaagtgtaagtgttattggccctaaagaggaagtacaaagagaaataggtgcaggaagtttattcaaaaagataataacagagaacttaacaaacctagagaaaggtgtaaatattcaagtgtaaaaacaccaagcagatttaacccaaataagactacctcaagacgtttaataatcaaactcccaaagatcaaggataaagaaaggttcggaagaaataatataaatagagttccaatatgcctggtagcagacttttcagcggaaaccttacaggccaggagaaactggcatgacatatttaatgtgctgaaggaaaaaaaccttttatcttagaatagtatatccaacaaaaatatcctttaaatatgaaggagaaataataactttcctggacaaacaaaggttgagggatttcatcaacaccagacctgtcctacaaaaaaatgctaaagggagttttcaatctgaaagaaaaggacattaatgagaaataagaaaacatctgaaggtgcaaaaaactcacaggtaatagcacagagaaaatcacagaatattataacactgtaattgtagggtataaactattcatatctcaagtagaaagactaaaagatcaaccaatcaaaaataataactacagccacttctcaagaaatagacagtacaataagatagaaatagaaacaacaaaaagttaaaaagtatgcagtgggggggaatgaagttaaagtgtacagtttttattagttttctctttgcttgtttgttagtctatgcaatcagtattaagttgtcatccatttaaaataatgggttataagatagtattttcaaacctcatggtaacttcaaatcaaaaatcatacaacagagaaaaaatatgcaaaaaataaaaagcaagacattaaaacataccaccagagaaaatcacctttactaaaaggaagaaagaaagaaaagaaagaaggaaggaaggaagagaagaccgcaaaacaaccaggaaacaaatatcaaaatggcaggagtaagtccttacttatcagtaataacattgaatgtaaatgaactaaactctccaatcaaaagacagagagtggctgaatggataaaaaaaaaaaacaagattcaacaatctgttgcctacaagaaacccgcttcacctataaagacacacatagactgaaaataaagggatggaaaaaatatactatgcaaatgtaaactgaaaaagagcaagaatagctatacatatatcagacaaaatagatttcaagacaaaaactataagaagagacaaagaaggtccatatatgatgataaaggggttacttcagcaagaggatataacaattatatatatatataatatataatatatattttcacccagtgctagagcactcaggtatataaagcaaaaattactagagctaaagagaaagatagacctgaatacaataatagctggagacttcaacagtttcagcattgaacaaatgatccagacagaaaatcaacaaagaaatatcagatgtaatctgcaatacagaccaaatgcccttaatagatatttacagaacatttcatccaacagcctcagagtacgcattcttctcggcacatggattattctcaaggatagactgtatgttaggccacaaaacaagtctaaaaaattcaacaaaattgaaattatatcagtatcttctctgaccacaatggaataaaactataataaatcagtatcaagaggaattttggaaaatataaaaacacacggaaattaaatagtatgctcctgaatgaccagtgggtcaatgaagagattaaaaaggaaataaaaaaatttcttgaagcaggtaataatggaaacacaacataccaaaacctacgggatacagcgaagccagtactaaagagaagtttatagctataagtgcctacatcaaaatagaagaaaaatttcaaataaacaatgtaacaatgcatcttaaagaactagagaagcaagagcaaaccaaacccaaaattagtggaagaaaataaataaagatcagagaagaaataaataaaattaaaatggagaaaacaatatgaaagatcaatgaaacaaaaagttgggtttttctttttctttttttcctttctttttttttttctgagacagagtttggctctgtcacccaggctggagtgcagtggcatgatctcagctcactacaacctgaacctcctgggttcaagcaattctcatgtctcagcctcctgggtaactgggattacaggtgtgccaacatgcctggctaatttttgtattttttgtagagatggggtttcaccatgtaggctaggctggtcccaaactcctggtctcaagtgagccacctgctatggcctcccaaagtgctgggattacagggatgagctactgtgcccggccaaaaaaatgattttcttaaaaagataaacaaaatttttgtcagttgacaagacttaaatctaagacttcaagctatgaaactattaaaagcaaacattgggaaaactctccaggcaagtgatttcttgagtaataccttacaagcacaggcaaccaaagcaaaaatggacagatgggatcacatcaagttaaaaagcttctgcatagtaaaagaaacaatcaataaagtgaagagacagcccatttaatgggagaaaatatttgccaacgatccacctgacaaaggattaataaccagaacgtataaggaacccaagaaactctataggaaaaaaatctaggccaggcgtggtggctcatgcctgtaatcctagcactttgggaggccgaagcaggtgaatcacctgaggtcaggagatggagaccagcctgaccaacatggagaaaccctgtctctactaaaaatacaaaattagctgggtatggtggcccatgcctgtaatccagatcttcgggaggctgaggcaagagaattgcttgaacctgggaggtggaggttgcggtgagtcgagatcgtgccattgcactccagcctgggcaacaaaagcaaaactccgcctcaaaaaaaaaaatctaataatcccattaaaaactgggtgaaatgtctgaatagacatttctcaaaagacatacaaatgaccaacaggcatatgaaaaggtgctcaacatcactgatcatcagagaaatgcaaatcaaaactgcaatgagatatcatttcatcccagttaaaaaggcttttattcaaaagacaggcaataacaaatgctggtgaggatgtggagaaaagggaactctcgtacactgttggtgggaatgtaagttggtacaaccactatggagaacagtttggaggttccttaaaaaattaaaatggaactatcatgtaatccagtaatcccactgctaggtatatacccaaaagaaaggaaatcagtatattgaagatatgtcttatctctgtactcccatatttgttgcagcactattcacaatggccaagatttggaagcaacccaaatgttcatcaacagatgaatggataaagaaaatatggtacatatatgcaatggagtgctatccagccataaaaaggaattagctcttgtcattgtcaacaacgtggatggaacacgaggtcattatgttaagtgaaataaaccaggcacaaaaagacaaacttcacatgtcctcacttatttgtgaaagctaaaaattaaaacaattgaacacatgaagatagagagtagaatgatggttaccagaggttgggaagggtattgagggtgcggggaagggacggtgagacagtggggatggtaaatacgtataaaaatatagttagatatttagaattaataagatctagtatttgatagcacaacaggttaactatagtcaacaataatttattgtacatttaaaaataatcatttgtaacacaaagaaaggataaatacttgaggtgatgcatacccatttgcccatgcaataatgcctgtatcatgcctgtatcaaaacatctcatgtaccccataaatatatacacctactacatacctacaaaaataaaaaaaaaacccctggactctggagtcagattcattcaattcaaataatatttattgagagccaaatagcagacattgttccaggtgctaggaacagaatcgtgatcctggcttcatggacttccattctcatgattgcctaggttcaaatcctaactctacctcataacctcaggaaatatgttttactgtctgaacttatctcttaatttgtaccagattcatgtttgttgcaagaatttacagaggcaatgtatataaagcatccaatatcatgcctagctcattgcaagtgtcacttatttttatttttgggtgaaagtctgatgcaagccatatttatgccataaatttaattggatgtgaatatgatctactagttgaaatgactctgatttctatgctttttaatctagtctgagcagcatttatgatacagtaatggccaaaagacaatgaaaacactattatttatcttaataagacaatcctaagccaaaagaacaaagctggaggcatcacgctacctgacttctaactatactacaaggctacagtaaccaaaacagcatggtgctggtaccaaaacagagatagagaccaatggaacagaacagagccctcagaaataataccacatatctacaaccatctgatctttgacaaacctgacaaaaacaagaaatggggaaaggattccttatttaataaatggtgctgggaaaactggctagccatatgtagaaagctgaaactggatcccttccttacacctcatacgaaaattaattcaagatggattaaagacttaaatgttagacctaataccataaaaaccctagaagaaaacctaggcaatactattcaggacacaggcatgggcaaggacttcatgtctaaaacaccaaaagcaatggcaacaaaagccaaaattgacaaataggatctaattagactaaagagcttctgcatggcaaaagaaactaccatcagagtgaacaggcaacctacagaatgggagaaaatttttgcaatctactcatctgacaaagggctaatatccagaatctacaaagaactcaaacaaacttacaagaaaaaaacaaacaaccccatcaaaaagtgggcaaaggatctgaacagacaatcctcaaaagaagacatttatgcagcccacagacacatgaaaaaatgctcatcatcactggccatcagagaaatgcaaatcaaaaccataatgagataccatctcacaccagttagaatggcaatcattaaaaaatcaggaaacaacaggtgccggagaggctgtggagaaataggaacacttttacactgttggtgggactgtaaactagttcaaccattgtggaagacagtgtggcgattcctcaaggatctagaactagaaataccatttgacccagccatcacattactgggtatatacccaaaggattataaatcatgctgctataaagacacatgcacacatatgtgtattgtggcactattcacaatagcaaagacttggaaccaaccaaaatgtccaacaatgatagattggattaagaaaatgtggcacttatacaccatggaatactatgcagccatgagttcatgtcctttgtagggacatagatgaagctggaaaccatcattctcagcaaactatcgcaaggataaaaaaccaaacaccgcatgttctcactcacaggtgggaattgaacaatgaaaacacttggacacaggaaggggaacatcacacaccggggcctgtcgtggggtggggggaggggggagggataacagtaggagatatacctaatgtaaatgacgagtaaatgggtgtagcacaccaacatggcacatgtatacatatgtaacaaacctgcacgttgtgcacatgtaccctagaacttaaagtataagaataaaaaaaaatgtagtcaattgtggtgagtcataggagggatgccaagtgtggaatcaccacagatgccagtcaaggctcaacgtgaccagctgttcagggtgctttgacaatcccaagccttgaaactacctaaaggctccttctgagtcaaatatcaaaaaaatggatcccaaatgactcctaatatgatttctcccagatgctctttctgataactttgtttccgacgttgatatctgatgctctcctaattactttggaccactttcttcctggaagactctatatggctcttatcattgagcagctctttgcaatgaagatgggaaaagacctccactatcttctgttatgatctaaggccctcgatgaggtacccattgcctccatgtatcttcctgggaaggcctttctgaggctttggctggtatcttaatttcttgtggaatatacatactggtgttctggtgctgtgatgtctggatatgttgaggtattgaccataccctggccagtggttttccttttgtttatatggagagagtccctgctctggcaagggaagagatgaagggaagagagggtagaagaggggaggggagggaagaggaggggagaggaggggaggggaggggagggaacaatttactgtgcctttttaaaaagagatcagccaataaaaaggtagattttggagacagacaaatctaaaaaaaaaaaaaaaaaaaagaaatgaaggttccaaattgatcacctaaatcatacagtcctttatcaaaatgcctggaagcctgtctaggctggaggttggctaacagcatacactcagctgacccggggagtactgatttattttcctatgttagaagttaggcctcatctgaaaggcagagagaagggcatcatcacactctatgccctatggactgggattggggtgggcactggagactattcaagagggcatttttgggaaaataggaagagagctcatggtggaagacagggaaagtaccagtagaagccgcattctgacaacattccacaaggagagaagctaattaaaaatgggaacctgacataggccaactaaatgagtatctctggggctgggatctggcagtgatctttcataagaaaaactcccctagataattctaacatagccagaggtaaaaacaacaacaaaaaaccccactactgctccagactagtagttctcaaagtgtaattcgcagaccagcacacgtgggtatttgtagaagtgcaaattaacaggaccccccaccaccccagatctactgaaacagaaactctgagggtgggactcaggaatctgtgtcttaacaagctctccagtgattctgatgcttgctcaagttggagaactactgctctagataagtcataccagaccaaaaaaacaaacaaacaaaaaaattaggaaggtcaggaaggcaggcagggtaaaatggatcagggtggaagtccactgtggtttccttttgtactttagagaagaatgaaaaacgcacattgctcacttccatacaactttggagaggggaaggtatctaacccttcacctttctctctcctaaagctccttcctaggagccattaaatgacagaggcctcttggttccaagtgggttttaggatttttaaataaaatgcagagactaataatgaaatttgttggaccatcagaaaggacagcagatggcccttgtgcctaggagggagggagggagggtaaccgctttccagaccaggaaaaaataaactaagaataaaaagaaaaccaaatgattaaaactgaactttgctttacttttcccttttatttcatgaaagcagtgtttgggcacagtagagatatgttaataaaattgaataatgtctcttgcactaagttttcagtacaagatgaaaactgcataagaacatgttctaatgatgcgttggttttctcacagtaacatccagcccccagaacattctctggcagcacccacactctcctgtcctagtgaataaacctggaacaaagctgaaaatctgaggagctgccgcctggatggggaaggatatgcttgtgaaatgtagcttggctctgttgctgacttagatgggagtacaggaaagtcattagtttctctggccctcaattttctcaagtaggaaatgacagaaaccacccaaatgaactgaaatgtcaaagtgatctccacaggcccaggaagagggccaggtgccatagccaaacaggatagcagaaaatcgcacaggctcatggtgtcacattctggtaaatgggcatgatgaaatttaactaagctgaaaaactgagaagtttagtgatcaaatgtgggccaaacattctatgggcatttttgttgttgcttattttaatggtcttttcctcctcatactcacatgctgtgcaaaaattatataattatataaaaaatatgaattatataagtaaagaaccccaaccaaatctcaactgattttgtgaaaaagaaatatcttttttttgcttactcttaagttctttttatcagaaaacaaataccacatgggattattattttaaacacaagctgcatttaagagaaagtgtctagtaaaccttctggggctgtaaattagctgctaattttgtttgactaaaggctgtaaaatgcatttctgggaattattgtgcacagagaacatcctcctaatacttcagtgggcttgaacagagaaatggaatcctattcagtatacctgttactaaactgaggctactccacgacccaggctcattctatctaactacatagccagcttttctggatttgtgaaagatgagattttgggaaagaacatgagaaacaatgagtcattcacagacacataagtagagatttgaaattggtgttcagaccatctaatcttcacatttcctcctttgttcaatctcattccagtctctgaaattttccaagggcctgtttattactctgttctattcacctactgctatgttcagttactgccccctgtttctctaatggagttttgctttcaagactgggcacaactcttctcaatatgtatttacatttttcatttccttatacaagttccatcattttttctttatgatagttttctttaacctgtttattcatttgtttcatttgttatattttcatgttttttatcctggtccttattttcctccatgacacctcttcttatacttgatgttgttctctagaatgctgttaaatttgctacctgtctctttcaaaatttacctgggcaatggtagcacacaaagggccatgcagacttgccaatattaggctggtttggcctagcatagtacctggcacacagcaggcattcaatcaatatctgttcagtgactgcctgaatgaaaatagaaatgatatcagtagttttttgcaataatcttaagcaaaattataaactaataacttccactcctttaaatgtgtgtcaacttttctgtactaattggaaaaacatctagttcatgtggatcaaaattgagtctatatgctacgtagggcaaaggcatgcctggattttaacatctcatcctcagtgactctaatggtgcctggcacagaggagatgcccaataagtttatatgaaatggcttagaatggactaccttctccatgcgactaatgatctgttactacttcctgaaaggttagccattattgatataccacttctagatgctgtgacaaatggcacagctcagcagcaaaagtactttttaaagtctatgggcctccacaggttgagtttgaaaaggatctgttaatcctctgaaattacatgtgatttatggggagaaagtttacaaaattattaatactcttgaaggggaatatgacctccccccaccccaaatttcagaaccacagtggataatgaaagtttctatgctgtaagagcaattaggaagtcctgaaaaacagggaatttagtcaggagacttgagttgaaatcctaactctgccccttgctggctgggtgaccttggccaagttttaaactctttcttatcttcagtttccttattatgacatggtgatgttaatgacaagtctctagacatagtggttaaacttcaacttgaacccaaatttttctggctctaaagcccaggctcttaacatctatcatcctacattaattaaatgagataactgatgtgaaaatgcctgatgtaaatatttgttaaagcaacaacaaaaaatgtcatttgtcaaagtaacaaagtattttttaaagtaacaacaaaagagacagataaccacaaagaaaaggccactttagaaattcctctttgacctattaaagaatgttcaagttcaaaatatgtttgtcattatgattaaaaatccaaccccaaaacttgggtgaagacggcataatctgttagtttggatatatacagactaaggggattctttggaataccctttgtctagagtgatcttatgacatggtacggataactagactcacctaacattcaaatgaagggctgtgtgtcttctatactttgtagacagaggtggcagatcatctgcttttaaatatagagggctcccattctgctaggatccagagggaatgagggtcctatgttacagatgtccctctgcctgcacaaaaggctgaagaacaagccatcatggagtgtgggagatccagctgttgtccatttccagaagaggagtgaatagtggcttaacagagaggacccttgcctggttctctttggaaatttcacagtagtgaggccaggtgcggtggctcatacctgtaattctggcactctgggaggctgaggcaggtggatcacttgaggtcaggagttcaagactagcctggccaacatggtcaaaccccgtctctactaaaaatacaaaaattagccgggcgtggtggcgtgcacttgtaagcccagctactagggaggctgaggcaagagaattgcttgaacccaggaggcagaggttgcagtgagccaagattgtgccactgcactccagcctgggcaacacagcgagactctgtctcaaactaacaaacaaaaaatttcacagtcgttatgaacagataatatgctcaggtattagccatttcattgcattgttttgacaagtgacaggaattaggtttgctaatgttggaagaaaaatctcacttgttgcttttaacttaaaccttttatggttttgagataggtttattcactgggctggagaatgaaggatttatctgtattagtcggatttgatcagttttcaagtagctactcagtgtcaggcctatacattatctcgtttaactctcttaacaccatggtaaggttgactgtatcataatctccatttatcagataaggaaacaaagattcagagaagtcaccaagttgagatcattgcccagctgcacacagctagtgagtggtgaagctgagacacaaatcagggcttccgacgccactttctattacactttactatgctgtgcattcgtgtaaaagcatgatatttttaaagtggcattccagctgccagaaggatatcaaatcaagtactaaagacaatattattagaaatggaaatctggactcaccaagaaatgtcttcagttctatataataggaagactggtattttgcttgatatgggtgtttcaatatcatctgctcctaaaatgcagtctagacacctcttgtgacctgctcaggtgatactaatgaagtttgggtcatttttagcatctacagagaacagagtaagagtgctgtgtgttcaatactattgcagacttatgggataaactggattttcttgctttactttataaagctaatgcctgattacaaatataagtttaaaacaaacctcaaaatttcttggcacccactctttgtggttggtaacatggacatctgtataaaatacccaagaccttcatagagcaaaagtgagtgggaaattaatttttattgggtatataatcatcactagccatgttcaaatactttttctctaaatcctttacaaagatcttgtaagttgggtattattacattcagtttagactaaacgaaatgcaaaaaaaaaaaataataaagaaaatagactcacaaggtaaagttgcatacttgagacataacaaaattaaatttcattctatgatgctgccacatagcagatgatacaagcagtatagaatacccataaacattatgttttaaggtatttccacctgtatctttcttggggcaggtaaatgaaactcactataaaccagttacaggtcctcctttatctgaggttttgctttctgaagtttcagttacctgcagtcaaccatggtctaaaaatattaaatgaaaaattccagaaataaacagtttattacgttttaaaatggatgtccttctgagttgtgtgatgaaatctcatgccatcctgctccatccctccagggatgtgagtcatccctttgtctagtgtatccatgctgtctgcccttagtcagccttcttggttgtcagattgattggtacaatggacacaaggtattaccgtgcttgtgtctaagtaacctgtgttttactattattacagtctattgttatagtttctattttaatataagttattgttggtaatctcttactgtgcttagctgataaattaaactttattatagatatctatctatatctatcacagatatatctatagatacgtacctgcgatatgtatctatatgcgatatgtatagatacatatcacaggtatgtatctatagatacatcggtatatatatgaaaaaacagtacatatagggtttggtactaaccacagtttcaggcatccactgggtggggatgcgggtcttaaaacacaacccttgtggataagagaggactactatatggaaagtcagagttagagagcttttgtaggttatgtagttcaatcttttgttttgctggtaaggagaagaatacaccttaattttgacttcttaactcgaaaagttaagaaacttgtctaaggtcacagagctagtggcagagcaagccaagcatcagtgtctccaaaatccagctcagtgttgtttgtgttatatcagaatgagtaagagttaagataagaacatgagtcttacagctccactatccatgttcaaattcttgctgaatgattggggaaacttacccaacctctctggacctcaggttattcacaagtaatacgaatataacagtatttgatagagccaattaaatgagttaatatttgcaaaatgctgaaatcagtgcttgccccataatgaatactcaataggtatttagatatttttattcttatctttcctcccaagcccaacctagtgtagaaacttctggaatggttgaattgaaggagaaatagtataaacagtataaaaaggtaaactttttaaaaagagaatcatgaagtagtgcttctacagagattgggggatggcaaacaacccatggagtaaattcacaagacttgacacttaagaatccaagagggctgcatgagatgagtccaggtaggcctcgtagacaaatcttagatggagttaactcaggaagccaaggagtatgagccagtagtcatcctgagcaaggataataatttttctttctgcctgccttcttgccttcttgtctccttgcctaccttccttcctttcttccagctttccctccctcttttccttccttccctatctccatccctcccttcctttcctacctccctcccttctttcttcttccctttcctccttctttccttccttcatttcttccttctttcctttcttcctccctctctcctacccttcttccttgcttccttcctccctccctcccctcccttccttccttttccttccttcctttccttccctccttcttcctccctctctccctccttccctacttccctccctcctactttcttctgtttcctctttccttcctctcttcttctttcctccctctcttccttccctccctcccaccttcctccctttcctcttccttcctctttcttccttctttccttcctccctcccatctccttccttccttccttctttctttccttcattcctccctccctcccttccttttttctctacctccctccctccttccttcttccttttcctccttctttcctttcctttctccttccttccctccctcccttcctgccttccacccttcctaccttcctgccttcctgcctgacttcctttcttccctcccccttccttctttcttgccttcctgccttgcagtcaccgaatgttttttgagtgactatgatgtgccaagacccggtataagggtgcacgaaataaagtctctaccctcaggagcttacttcctagtgggggagacagattataaacaaagacacaaataggtaatatactattatgtggtgaaaaatgctacgaagggaaagtcacagggagcatttttgtttggtttttttttgttgttttatatagaatggtcacaggtgcctctctgaggagcccttggagcagacacctgaatgaagtgaagccacatgcctggagaacaaatattcagactgagataagagtgaacacacacctgcagtgagagagagagagagttgggtgtgatttgcagacctgtaggaaggccagtgtggttgggcagagggagcagggaatgtaggcaggggccagatcacccagtatttgtaaactgaggcatggactgaatgatagggcggcttcattcatccaccaaaccacgtgctgagtaatctaccccaattccaaagcatgaacttgacaactgcttcttcatagtaatagatgaaggataaaaaaatttaaaaagcatatagatgagccaacttttatgtgcttaaagtgaaaacaatcatgtctataagacaaaagaaggaaagacatttgacatgctccatgtacctgagattcatctcgtgttaataaaatgttgaacatattacactattggccggtgtttagtttcagctgaggaactaattcctaaagctgcagcctgggggatggggagatagggtggacactgagacagggcatggaggaattcagatggtatttaccccagaaatatttactgaaattgggaatgctgagtcaagcctagccatgctagagggccttgggaaggcagttactagaatctccttgatttttttccaatttcagaagaagcaacaagaagaaagtgtcttgactaatccttctagtgaaagatattcacttttataataaggtgcttgtctacacagaggtttctgagtcaaaggaggagaacgtacaaaatagaccgaaagaagagcctgcctagctgctctttttcttttgtaattaccaagatcccgacggtttatacccactcaactgcaggtgctgggagaggagaggctactgtgacaaaaattatataaagaagagcccagcagatgcatttccagataaacaatgtaaaacatagtctatgtaagtgccataaaatttcactaataaaaaacacacatggctcagggaaacatttattatcaaaatggaagcaggaaagggcatatgctaagtcttattcatttcaataaatagcagaacgtgaattgataaaagttcttaattgaaaaacagttgctcatttgtagtttgatatttaaaagctttctaaacatgtatttattttgttttgccttgaagtaattagctattagactaactattttcttttcatgtcaggtacacagtggctccaaagtcaaaacaaggttagattggaaggaagcaaacaatgaaattgaagggaaatatcgacacttctcaatcaatgaaaatgcatcagcatgtatgagcatctttagctggcaataatacatcagaaataaataatgttagcaaaagagacagcatcattggctattcatagtatgtattcacggttgtacaataaaattctaaaggctgaggttgaaagtgaataaaaattattagttctaaacacttgaaaattccagcagcttagacatatttttgtatgctttcagtgccccaaatgtaaaacttaaatcattttatgaaaaaaccttgttcaatcttttaagaaatttgcatttcattgcaaagatggaacatagcatccttggctgagttattttctatagaagtcagtgccattttgtggtatatgattagcacattctaaaggcaaagattccagaacgtttaaatttagttgtgaaaaactgaaggcatttatccattcatatataagcatgaaaatgcaagcttcactttctcagtatgtttaaatgccacatattataatgggaattctagaagatgtgatcatcaaactctgatttcacgcttagaaatcaaataaaaaagagactggcctataattagaaaattagtcaagtcagatctaatatcaacacatggttgtcacagaacaaaaaatttttgctttgagaaaaatgagatatcattctggatgaatattctgggtcagtagaaaatagggaatcaaagtatagaaataaagtgtttatgtcactgtaaaacttctagttttctaaaataaaatttaaatatctgaaatagcagtttatacttcatactcatacagtcaatagacattggtagcttaagaaagaacttggtaagtgatgatttaaagagtgatatagattcagtagtattcaatatacagttgtaattgatgagctcatcaaactatggaatttgggatatttacataatatttacattatataatatgggagagatagcaagtatctataaagagtttaaattcccatactaggaaatgtatagtttgttttaatctatgtctacatttaaagtagatttttttttcagagacagcatatagttgggtattgctttttaaatttttaaatctaatctttgtcttttaaattatatttaacgtagttgttgatatggttgaatttatgtctattaccttgctacttgttttctatttatcccatttattcttgtttttttccctcaatgtctgccttcttttggattatttgttttagtattccattttatttccattagtggtttattagttatacctccttttaaatttatttacctaattttagttggtgccacaaggcttaaagtataaatctgtagtttatttttggaggatctttgccccacagattccagtcttaccatgctatttattttttagcgatttgattacgctctggtcaatatgtgattatgtgcaaactgtgtgtgtgtgcgtgtgtgtgtttatcttgcttgaggtttgttgaatttcttggatctgtgggcttagagtactcacataaaacttaaaataaatttctatattcttttttctggtatactgtctatgcactcttaattcatatagtcatgtttttatgtcagatattccattttttgtctttaaataatataccaattaatgtataacgtgatccttacaatagttatacttctatttccccatttttcctgctattgtgataatacattttacttctatatatgacaaaaaaccccatgatatacataacagtgtatataataataacatatttttgctttaaatagctaagtcttttaaataaatttttaaaacgagggccgggcgcggtggctcacacctgtaatcccagcattttgggaggccgagacaggcagatcatgaggtcaggagattgagaacatcctggctaacacggtgaaacccatctctactaaaaatgcaaaaaattagccaggcgtggtggcgggcgcctgtagtcccagctactcgggaggctgaggcaggagaatggcgtgaacccgggaggcggagcttgcagtgagctgagattgcgccactgcactctagcctgggcaacagagcgagactctgtctcaaaaaaaagaaatttttttttaaatgagaaaaagtattttatatttatccataaatttaccacttacatcacttcatttctttgtgtagacctgagtttttatgtggtatcattttctattttttaattaattaatttttttttgagatggagtctcgctctgtcgcccaggctggagtgcagtggcgcaatcttggctcactgcaacccccgcctcccgggttcaagcaattctcctgcctcagcctcccaagaagctgggactacaggtgcatgccaccatgcccagctaattttttttttgtatttttagtagagacggggtttcaccatgttagccaggatggtctcgatctcctgaactcgtgatccacccgcctcggcctcccaaagtgctgggattacaggcgtgagccactgcgcccagctatctttctctggttttcatagtttatggcaagaaacctgcagaatttcttacctttgttactttgtgaagtgtcttttttctctggatgcttttagattttttttttttagcaatttaattatgctgtggttaatatgtgtaattatgtgtaagctgcatatgtgtgtatgtgtgtgcgtgcgcttatcttgcttgaggtttgttgaatttcttggatctgtgggtttgtagtcacaccaaatttacataatttggtagccattatttcttgagatattatcccccatccattttttaatgtgtccttttttcccccaaatatacatgttagactgcttgatattattccacaggtcacttaggctctgctaattttttcactactctttttttctacatacttcattttggatgattctcttactatgtcttcaagttcatgggctttttcttttaatccaaatggtcacattttcatgtcagatattcttaatccaaatagtcacgttttcatgtcagatattctgttttatttttgtctgtagaaatcacatttgggctttaaaaaatatcctcaatttctctcctcatttcatgttttcctttaaatacttgcaaataggtttttttgtttgtttgtttgttttgagacggagtctcgctctgtcccccaggctggagtgcagtggcgcaatctcggctcactgcaagctccgcctcccaggtacccgccattctcctacctcagcctcccgagtagctgggactacaggcacccgccaccacgcccagctaatttttcattttcgtatttttagtagagacggggtttcaccgtgttagccaggatggtctagatctcctgacctcgtgatctgcccgcctcggcctcccgaagtgctgggattacaggtgtgagccaccgcgcccggccgcacataggtattttaacattcttgtatgctagttccattatctctgtcatttctgaatctatttctatttaatgcttttttcctcctcataatatgtcacattttcttgtatcttgtctagtaatttttgatagaatgctgaagattataaatgccaggtcatctggattttgacttccttaaaaaatattaattttggttttggcaggaagccaaacaaaaatccagatctaaagtccaagtttctagatatttgcccctcagcttctagcctgagcctctccaaactccagtctctgtcttctgagtcagccaggaagtaaatccaagctgttttgggttacccttccctctgcttatggaccataaattgcctcctggaagaaacctggggcaattgtagaaatcactttttttgtcttcttcctctcagagatcacagccctaagctgcctacaatctgatgtttgaaaacagctgcaccatatattttgttcagttaaattttttttttttaggccaggcatggtggctcatatctgtaatcccagcactttgggaggctgaggagggaggactgcttgagctcaggagtttgagaccagcctaggcaacatagtgagactctgtctctactaaaaataaaaaaaattagctgggcatggtggcacatgcctgtggtcccagctactcaggagccatctcaccgcagcctcgaattcctggcctcaagcgatcctcccacctcagcctcctaaagtgctgggattacaggcaaacaccactatgcccggctattgttcagtttttttttcttttgttttttgttgtttgcttttgcttttttgaggcagagtctcactctgtcgcccaggctggagtgcaatggcacgatgtcagctcactgcaacatccgcctcctgggttcaagggattctgctgcctcagcctcccgagtagctgcaactacaggcgcataccaccacgcctggctcatttttgtatttttagtggagacggggtttcaccatgttggccaggctggtctcaaactcctgacctcaggtgacccacccgccttggcctcccaaagtgctgggattacaggcgtgagccactgtgcccagcatattgttcagtttttaatgggaggttagggacaaattttgatactccattaacagcccaaagcctatttcccaaatctgttttagatacccttagatgaaataattcttacagaaaccatgagaccttaaatgattaatcataattatcaaagaaaactcctgagcagttaatgtcaaatgtaatatgatgtaagtaagttgattgataatattcgtgtcttgttaaaagaggctactttagtctgctgagatactgaacggattttcctaagggaaggagtatctgatatgaaataccagttaatcatcagtcaccaaccattaattaaatggctactttataaaggacattaaactgagcgctagatggagtatgttgttgcagtcatttcatagaaaagtctacaggggtaattataagaaaaagaaattgggtatttcaaagatctagtcactgatataagtggaatgtgatatcaaatgtgaatcaatactttaaaataatttttattaaatgcttattagatacagaagaatgctataaaaatatatgtaaacttaaaagtagtgcttctgaaactttaatgtgcaaacaaatcacctgagatcttgttaagatgcagattctgattcaggagtctggggtggggcctacctctgtagttctaaaaaaaaaaaatccaggtgaggacaatgtttctgctctgcagactatctttggagtagcaagagtaagagaagtgaaactacaatgatcatctgtgtgcccaccactggtgtaagaaaaataactttatttttatctctaatgtcttctgggtaccccctcctgatcccttccctccctcttagaaatgactacttccctccctcttagaaatgactactctcttgaattttgtttttatcatccttttgcttttcttaaaagttttaacacatttgcttgtcacttcaatatatattgttagggtttgcatatttttgaatgcatgaacctaatataaatggaatcatttgcatatatccttcttcaatttttcataccacattatgttcctgaggttaattcatatcattgtaatcatagtttgtataaacttaatttattttcatcactgtatggaattctattgtatgaatatacataattcattttaccgttgttgaattttgaaatttaggttttatactgccatgaaaattcttgcataagttcctggtgcacacatgcaacacttagtcagattatatacataggtgatgaattgctggctcataaggtatacacattttaaactttagtagattatgccaaattgttttctagagtggttatattgacttgttctgccaccaactgtgtgtacaaatgttctggttgttcctcatctgtattagttttatattgctgcacagcaaattgtcacaaatttactggcttaaaacaatatccacatattagatcatagctctataggtcagaaatccaggtgggcctggatgggttctctacttggggtctcaccagtctaaaatcaaagtttcagctgggctgactcttatctagaggcgctgtggaaaaatctgcttccaggctttttcaggctgttggaaacattcagttattggcagttacagactgaagccccttttcctgctgtctgttagctgctaaggaccactctcagctcctggaggccactctcagatccttgtcccatagccccctccacttatcaatggagaccctcctttgcatcaaattcctctcatgcttaaaatctctctgagttggataaaagtcaatatataaagagctaatgtgattagattaagcatatccaggcaatctcccttttgtcatataatgcaccatagtcacaagaataattccagcgattaaagttatgagggtcatctatagaattctgcctactctagtttactgatagccagactggccccatgattcactactgtttcataggtaaaatatattcaccacttcccaaggttcctagtgctttgattccattacagcatcagttcaaagtctaaaatctcaataaatcatctgaataatctaaaccagatggaatataaaaaggagtcagcaatccaaagcagtgttgaaatccagtggagcaaaactggttgggaaaactccactgagtttcaaggcctgggaataattctctttagctctcagctcctccctctccacttttggtttcaccctctgagtcaactttcttttttcataaagagtagatgaatagttttatctccctgcttctcgcagtagaatttgagcagatgtaagagtctcttttcattttatactctctctgtcccttttggtccagctggtagtatttctgctgatacaattttctcaagaactttctggatctcctgtggatatcacagtgattcactgcatcatacagaacacatgctgacaagtcttttgagataatcccttctctatttttggcttctactgaaatggttgagggacagaacccttaagcccagaggtcctctggtttaactgagaagatctgtgagaaacacccttaatctcctggaagggtagtttgtgtggtaaaatactctggccttttgatatttctgagttttcaacaaagaactgtatagtatacactcagacttttctttatgccactgttttagcagccatttatgacttttagcatccttttgccatctggagaggctgtgaattttctaaattatctactctggtttctgtttaaaagttcttccctcaatttatctctctcctttcacaatttactataagcaacaaggagaaatcaggctgtagctttaacacctttcttggaaatctccttagctatatattaaagttcattgtttacaaattctgctttccacataactgcaagatgcaactttgctagctatttggccactacataacaagactctcccttcctgcatttctaataatatgtttctcacttctttcttagtccgcactgacagcattctcaaagcccagatttttttaacctatttccttatattttaatgggttttctgtggctcatggtggctcatgcctgtaataccagcactttaggaggctgagtcaggaggactgcttgaacccaggagtttaagaccagcctgggcaacatagtgagaccccaacactgcaaaaaattaaaaaaattagctgggcatggtggtgtgtgcctatagtctcagctacctgggaggctgaggtagaaggattgcttgagcttgggaggtcaaggctgcagtgaactatgattgtgccactgtacttcaacctgggtgacaaagtgagactgtctcaatcaatcaatgaatagataaacaaaaaatgaatggaagttcttgtagacaaatatatgtggtttggcttttatttatccaatatgacaagccctaaattttattttatttattattttattttgagacagtctcactctgttgcccaggttggaatgcagtggtgacatcgtggctcactgcagcctcaacctcttgggctcaagtggtcttcccacctcagcttcctaaatagctggaactacagttatgtaccactgctcctggctaattaaaaaatttttttttgcagagaagagatcttgctatattgaccatactgaagccttgctttttaagatgatatttagatcatttacatttaatgtaattatcaatatttttagtttagtttcccaactttctatgtctttttatccaatttattttctcttcttttccttattcctgcgttttttgataagtatttttatgattacattttatttttcaggattggattattagttacacatttttgttttattatttttagtggttgctctagggtttacattattcatcttaacaaataacaccctacttcaaataatataataatatatattatttcacatatagtataaaactcataacttccattttcctcttttatcctttgaatgatactattgtctttcattttacttctaagatgttgtaaacctctcaacaaattgtttacatattttctttagacattcaattatcttttaaaatctttaaaaataagtaagaaaacatgtctcatatttatctacacttttaacatttccagtgctcctcatttctttgtgtaaatcccaatttctatgtagtgtcatttgtactgcctgaagaattccctctaatgtttcatttagcacagatctgccatcaattcatgttctctgcttttgtttgtctgaaaaagccttttttccttcagctctgagatattttttgctggttatagaattcagagttgacagttcttttttcttttagcactttaaaatgctattccattgttttttggcttacttatttttaacaagaagtttgtaataattcttttgttgttctgtgtataatatttctatttttttggctgtatgaaagattttctctttatctttggttttaagcaatttgtctatgatatgtcaaacagtgtttttaaaatattaattctgcttggtgttctctgtggtctgttatctttattaattttagaaattctcagtcattacctgttcaggcatttcttctgtgcatttctctctctttcctttttctacatgttaaaccaggtgatattttaccacagcttgtggatgctctgctcttgtttttctcattttttgtctctttgtattttagtttagataatttttattgtcttatcttcaagtcctctgacatattcttcttctgtgttcaagctgataatgagcccatcaaaggaattcttcatctctgatatattcttccttcatagcattcccattggacttttaatgactttctctctactgaaatttcccaacttttaatgtttgttgtgtatctcttctactggatcttttgttttgttttgtttttggagacagggtcttgctctgtcacccagcctggagtgcagtgatataatcatgggtcactgcagccttgacctaccaggctcaagctatccttccacttcagcctcttgaatagctgggactacaggtgtgtatcaccacacctggatttttattttattttatttttgtagagacagggccttgttatgttgcacagactgttcttgatctcctgggctcaagtgatcctcctgccttggcctccgaaagtgcttagattataggcatgagccaccatggctggctgaccttttaagactagagtcatagttattttgaagcccatgtctaatatttttacctgggccattcttaagtataatttttttgatgtttttatcctttgaaatgagtaattttgttcttgctttttgggctgtatcatattttttattgaattccagaattggtataaaagtatagtagaatgcgatttaaatagtattttcattaaaaatggatacacatgtttttgtgtcaagtaaacattcagaatcttaaagaaaaattgattaatttattctcagaaatgtgatatatagcatacaagataagaagtttgagcaataaataggtcaaaattgtgctgatgaacttcattaaaattttaacttcattaaaaattaaaattttaacttccttaaaaattaaaaataaaatatgtaattcaggaacatatatttctaaagtatcccattatactgaatattttagagtaacagttacaatggtatgtacatggcaagtaaaacagattttgaccttttcttgcaatagtagcaaaataataacaacaacaacataaaaaatcataatggtaaagtagcttatttacaaagtgaccaggagtaacattttatacccactctcacatgtaaagtgataagtggtacagaaaatgtattcagtgggaaatgtgggagagggtactccagagatagcagggagttataatggtctaggtctggacaatcacagcatcatatccctggattataatgattgatttgggaccggtcacagaactcaaacaaagactattagctctaacaagagctgttttgggaccctttgcagttagaactaaagttgtaaaaagataagactagattgacttggtgccattatgtcaccccaaagggtgagcctgaattaaaacagccaaaacacagaaaaatggagtgatggacagcaataagtttctgataatattatttaagtctttggattgagctatgcctaaagatctttttcagttataagaaccagcaaatgattttttcctatttttaaatgtaatttaattatttatctatgtttaaatcaacagataaaattgtatgtatttattgcatgcaacatgatgttttgaagcatgtatacattgtgaaatgactaagtataattaacatgtgcattatctcacagttatttttgtggtgagaacactttacttatactttcagcattttataagaatacaatatattaactatagtcaccacgttgtacaagggatctcttaaacttattcctcctatctaactgaaaatttgttatcttttgatcaacatctccccaattccctccttgcaatcaccttatcccctagtaatcaccattctactctctacttctatgagatcaacttttttagattccatatggtgagatcatgcagtatttatctttctgtgcctttcttaattcacttaacataatgtccttgaggtttatccatgctgttgcaaatgacaggatttcccttatttttttatggacaaatagtactccattgtgtatatgtaacatttttcttatccattcatccatgatgaacacttaggttgattccatatcttggtgattgtgaatactgctgcaatgaacaccaaagtgcagatatctgttttagatgctgattttatttcctttggatattatctcagtggtgggattattagatcacatggtacttatatttttaattttttgagaaacctccatactgttttccatggctgtattaatttacattctctccaacagtgtacagggttctcttttctccaaatcctcactaacacttgctatcttttgtctttttgataatagccattctaacaggtatgaagtgatatctccttatggttttgatttgaatttccctgatgattagtgatgttgagcaccttttcatatacttcttggccattttgtatatgttctttggagaaatgtcaattcagatcctttgcctatttttaaattggggctttgctgtgtttttgttttgctattgagttaactgaattccttatatgttttggaatattaactccttatcagatgtatagtttgcaaatattttctcacactctgtaggttgtcttttcactctgttgattttttcctttgatttgcagctgctttgtagtttgatataatcccagttatctatcttgcctttgttgcctgggcttttggttcatgttaaaaaaaataattgcctagaccaatgtcatggagctttctcctatgttttcttctagaagtttcatagttttgggtctaacatttatggctttcatccattttgagttgatttttatatatggtaggagataaggatccaatttcattcttctgcatttggatatccagttttcccaacaccatttattgaagagactgtcctttcctcagtgtgccttcttggtacctttgtgaaaaatcagctgactgtaaatgtgttaatttatttctgtgtactttattttgttccattggtttacgtgtctatttttatgccagtaccaggctgttttggttactgttattttgtagtatattttgaaatcaggtagtatgatggctccaaatttgtttgcttgtttgttttgctcatgattgctttgtctatttgggaccttttttgatttcatatcaattttaggattgttttttctgtttctgtgaagaatgagccaggcacggtggcttgctcctgtagtcccagcactttgggaggccaaggtgggaggatcatttgaacccaggattttgaaaaattagctgggtgcaatggcatgtagctgtcattcaggctgctcgggaggctgaggcaggaggatcctttgagcccaggagttcaagacagcagtgagctatgattgtgccactgcattgcagcctaggtgacaaaacaagaccccatctcttaagaaaggaagaaggaaagaaagaaagaaagagaaagaaagagaaagaaggaaaagaaggaaagaaaataaaaaaaagaaaggagggagggaggaaggagacagagaaaggaagaaagaaagaaagaaaaagaaagaaaaacagaaagaaaaagaaagaaagtcattggtattttggtagagattgcattgaatgtatagattgctttggataatgtggacattttaacaatattaattcttccaatccatgtgcatgagatctctttctatttgtgtcttcttcaatttctttcatcagtgttttatggtttttggtgcagagatcttttacctccttggttaaatttatttctaaatattttttgtagctattgtaattaggattattttcctaatttcctcttcagatagcttgctttttgggtacggaaacgctactgattttttttttcccaacaaatgatttttaacttagacaaatttacactgggttttatctcctttcaaaaaaatgaggctgatggaaaattcaagagtcaatgttttttttctaagagagaaacagaaaaataaataacctggcattagggtgtagtatggcctggagaaaagagatgctggagatcagcacagcagcaagagtcaggatgataaagagagagagagagagaaaaaaaaaaaaacactaagtaaccaaagataaagtactgagtgggaaaatattacttccaataagggaatctgatccagcacaaagtctgggctctggaggaaagaggcatgagaaagaaaaatataggatagctctttttaagtcaaagacatgaactgtttactccaaattagggcagtgaagacctgagttgcagactgtctggtgatatcttgcctttctgttaggtaagcactagggtggctgagctgagctgctgcaaatgtgacataaccggtttgggactatggtgtgcacctgcttgcgctatatgcatggcatgacccaattgagattatggtgtctttagttggcttgtcctagtggcagcaggtgaggtatccagatctgcacctgaaccgaggtatttgaataagtgatagaggagcaattcaaaaggcttttctgaaagtaagtcagtgagactggttgtgtgatggatgagggacctcaggaagagagaggagtaaatactgatgccaaggatgctagcttggactctggatgaacactgacatgtgtgactttgagtttaacaattgctaaactgtgatcaaaattatgggaggcattacactgaaaggcaaaactcaaagaaaactctaatatagtattagttgaaaagtaaatgggggtaccatgaagataactaaagccatatttggtatacatttaaaatgctagaatatgtcctttggatgtgctgtttgcatatagggtacacagaaggggacttttatcttgttaggttttatttcagatatataatggctctttttgttcccagtgaatttgggatgttctatgtgttgcttaatagtaaaatatttaaatgttaaattattagtatgcaatatgtgttagtataaatcaagtactttcattgaatctctgaagataaatacaaccatgtaatgtttaattttgactgtcttgcaaacgacctgaacatcaattaacaatctaataataatagtaactaacagtttttcatgctcaggcactattctaagtgctacacaatctggtaacctatttaatgttcacaactaccctacgaagcaggtacaattagttctcccatttactgatgaggaaaccaaatcactgggaagttaacttgctgaagtcgcatagctagtaaatagtagaaaccaatattagattctaggcagtctgattccagcgcttaaactcaaacactcatctttactggctacatgttgtatattcacatacacacacacaaaatttaacaaaacacttataaacaaagtactgtgagatctatagataagaacatccagtcttgctgttaggaaatgtggctgggaaaatagaatatttatatgaaaaagataataatagaagacagtgtgtaggaagtgacagatggatggcacagacaaatcactctgcagaggttgtagagaatggggcaggggtaggttacaggacagatggtcttaaactgatggataggacctacctgtaccatctggttcctgcccacctctctaaacttatcttcctgacattcaccaaattctagccacacggaccttctttgtgttcctcaaaatgccacactcttttctgtcccacggcttttacaattgttgtgtcttctgcctggaagactctttctttaaatcttggcaaggctgcctcctttattattcagaagtcagatcattgtgccctctgatatggtttggctctctgttcccatgcaaatctcatctcaaattttaatcccacatgtccagggagggacctgtaatccccatgtgtcaagggagggaggtgattggatcctgggggtgatttccctcatgctgttcttgtgatagtgagttctcctgagatctgatggttttataagtgtttggaagttctttcttcactcttctctgtgctgctgccttgtgaggaaggtgcctgcttccccttcgccttctgctatgattgtaagtttcctgaggtttccccagccatgcagaactgtgagtcaattaaacgtctttcctttataaattacccagtctcaggtagtatcttttagcagtgtgagaatggactactacaccctccttaatgagaacttccttggtgacccaaactgaaatactgcttcactcctaccccagtccactagcctgtttgatttcattcatgacactttccttacctgaaattatctacttgctaacctgcttatggtctgtttctcttcactagaatgaaagctccacgagcaaggatctatgatgcctgtcttgttctcatcttttttattttttccctcaagtagtttctgaagtttctacctcatctacacaatctttctgggctttaaaggctatgagggaatgtccctctttgacttgttttgaagccttgggcctacttatttgtatataagagaatatttttaaatggttctcttctttatatatttaaagcatgaaatgctctgaatatcaatgaacccaatcacatttgggtaatagaaaaggctgttttcttcatagttgattctttttttaaaaatttaatttcttatttatttattttgagagagagtctcattccattgcccaggctgaagtgcagtggcatgatctcagctcactgaaacctccacctcccaggttccagcgattcatacacctcagcctcctgagtagctggtattacagctgcacgccaccatgcctggctaattttttgtatttttagtagtgatggggtttcgctatgttggccaggctggtctccaattcctggcctcaagtgatccgcccgccttggcctcccaaagtgctgggattacaggcctgagccactgtgcccagcctgtagttggttcttttgaaatgttcctctcctttatgggccaagctgatagcatttgctttaccctctccatttcgtatatttatcagccatcaaaggcttttcttattgcttggaacttaattgaatgatgtttttgtttctttaccaacaaatgaacacaagcggctttcgaaaatactccaaaaaacagtgagctgtaggcaagattttattcttcatgtgtgatatattttggtaattaaggagtcaattctttggctaaatgctgaaagaaaaatgatgattattgtgtaggataaagctgtgaattatagaatactttcaactctgtttaaaatctaattaacattaattgttacattaattttccctgtgaaatttactaactgtatacaaaatgatatttaatcttcctaatggaggtctagtgtattcgtttcagtcctattcgtaggaatatgagttgaaatggcaaagttatagttatgttgaaagtaatgaagtaatttttatataaaactaatttattaactatcacattgtaattaattaaaacactcttacttttacacaatgttcctgtttttaaagtacttttgtgtgtgtgtgatatacatatctatatgtacatatatgtggattcccacagcgtcgtatgatacaagcagaaccattaattattatttatccccatacttatgtataatggagtttccatgaggtttaaaaacttcccctgtaacataaggatagtggatcatgaagttcataatttgtgaccttattaagttctaattactagggatacttcttgttttagtttgctagggctgccataacaaagcatcaagatttagtggttaggccaggtgcggtggctcatgcctgtaattccagcactttgggaggctgaggcaggtggatcacctgaggtcaagagctcaataccagcctggcccaacatggtgaaaccccgtctctactaaaaatacaaaaattagttgggcatggtggtgcgtgcctgtaatctcagctactcggaaggctgaggcaggagagaatcgcttgaacccaggaggcggaggttgcagtgagccaagatcgtaccactgcactccatcctgggtaaaagattgagtggcttaagtgatagaagtttcttttctcacagttttgggggttagaagtctaaggtcaaggtgtcggcagggctgactgcttctaaagcctctctccttggtttgcagacggctgccttctccctgtgttttcacacggacttccctctgagcatgtttatgtcccaatttcctctttcttataaggacaccagtcgtgttggattagggcctaccctaatgacctcgcttttgcttaatcacctctttgaagatcccatctccaaatacagtcacattctgaggtactggagattaggacttcaatttatgtattgttggaggataaaattcaaccataacgcttgtgtaaattgtgaagaaaacagtaattaatgtatagcttgttttaaattttctgagtgaatgagttaaagaggctatatgaaatagtaagtgctattttagccaagaaaattatgtctcagcacatgtggtttgtgtttcaaaaatatttcttgagtaaaatgtctgatttatctaatatttttaataatgctataacctttactattttgataatggtagtactacccgacatatattgagtcttaccatgtaccagactgttttaaacatatgccctgtattaacatatttaattattacaagcaacctatggaatactattattgccctaattttaaaaatatggaagctggccaggcatggtggttcacgcctgtaatcccagcactttgggaggccaaggcagatggatcacctgaggtcaggagttcaagaccagcctagccaacatggtgaaaccccatctctactaaaaaaaatttaaaaaattaaaaaaaagagagtaaactctgtgtaagaacgctaaatgacttgtcaaaggttctacggcaattaagtagcagaattggaatgaaacccaggttctcaggctctggaacttttgattagcaggccagtggttctcaatgggtggactctagtttctggctaagatggagtaagaggaaaagatttaccatccaatgtagaacaactaaaaaatgtatctaaatatgtaaaacaatggattgtaagacattggacttcatggaatgaaaggcagtgatccctgcgaggaaccatatagttgccccactttataatcgagagaaagagttcccaggcttgatgctcaggaaggtgatacctgacccctgcagcctgcagttggaacacagcactgagagtccagggagaccaatgcaatcagagtacagggaagaggacaagagtactctgcacagggagcgagaaagagcttcacagacagtcagagggttcccttgaatcatcagaggaaaacagattagtatatacatgtgcagaaactagccatggctggggaaagaactaccgaaggactagagggaacaattgctggaactcatctggggctggaatagttcctgtccccaaatcataactcatgggacattgggtagaatattcagaagaattttgactcggtggggaaaaattagccctacactaaattatgctagttccaccttaccaagcttaaaagaaagacctgaaagggtcaaactgtttccaagttgaagaggaaagggaataaacattcacgaattactgtcatcatcgtgaagggactctggatgtgaatcagtagctacacaagaaccttcagtgtctctgagcatgggaagatgaaaagatttgcttttcatgcaaggaatttaaatttccaatgtcatatatatgaggacaaaatacattagtgtctgagtgttcccagcacttctcctcttcaccccactgaaaagagtctatccacccagattcttcccctccacagctcttcagagagggttctgctggccagattggttcagaaagaaggtattaagaattaccagctgggtgtggtggctcacacctgtaatcccagcactttgggaggtcgaggcaggtggatcacgaggtcaggagatccagaccatcctggttaacatggtgaaaccccatctctactagaaatacaaaaattagctgggcatggtggtgggcgcctgtagtcccagctacttgggaggctgaggcaggagaatggcatgaacccgggaggcggagcttgcagtgagccaagatcccaccactgcactccagcctgggtgacagagcgagactctatctcaaaaaaaaaaaaaaaaaaaaaaaaaaaaagaattaccatgtgaatgatgaacacttcccagtgtttgttgataactgaagtaaagaccttgagatagtgttggaattactgtttggttgctgggtagtatttgtttacctctcacactactttcagatgggctatgttagtcatagctttaaccagattatagatttactgattggatagatgtttactaaaaattaagtgagcaaatgcaaggactagaacaacatagacaatatattctgatttttatttaaaagaaatatgcaaaaaacactataaaattttaccccaaatatacccatcagtataccaaaagtgtaccatgtatgctaacagccatataaaattactaaaaggatatataccaagctattggtaaaaggttatctctttcactggggaccaggattgggcaggtagaaggcagtaggaacatagcaaggagatcctttcactttgtattccgtatattgatgagttgcttgagttaaataaaacaagaattataatttgtcattaaaaaactaaatattaaaaattaccatcttcccagtgtttgcaatttttttttttttttttttgagacaagtcttgctgtcaccaggctggagtgcagtggcgtgatcttggctcactgcactctctgcctcctgggttcaagcggttctcctgcctcagcttcccaagtagctgggactacaggtgtgcccagttaattttttgtatttttagtagagatggggtttcaccatgttggccaggatggtctcgatctcttgacctcgtgatctgcctgcctcggcctctcaaagtgctggaattacaggcatgagccaccgcgcctggcccaggcttcaaaatttttaaacatttaactggaatagtaagtaaccaacaagcacttagaaagtgcctagtgtttatgattcctgccacctcagagagctacatttgtgttcaatcttcggacacttaaatgttttcaatgtatgtaaataattattgttaagattttcctaatttctttgttaaaatggttcatttcaaggttctttagagcttgcatttatttcattttttgtcatgtttcttttctcttagaataaaaaccagcagtcattttaattacccctgataatgttcatgaatactgccttggcctgtcttctggtttggaaccttttcaagggcgaatggatatttgtctggtgttccatgtataacctgtccttgtgccacttttccaatgtggcaggaagggaacaactgtcatctgttctgagaattcagcactgtgtctggcactgtgggaatttacccagactgctttgggggaagacatctgacacttcatgataattgtaattaaccagaaagacactggaattggaggatttgaagggaaatatgacaagggattaagactttgagattacttttggagccagggtgacttaagcacatttaaaaagttaggtttacttatatattattattatattctaaaccataagacattttctaataaggtttctaagaggaacatgtaaacctggatcaaatttaaataaggttactgaaaatattaatgaaaccaatgactgagcattttataaatgagaactgtattgctttaagttggagaaaagctgcaagtaagacaacatatttcttcatttgaaagcttgtgtccttatatgagggacattgacaaatgagtggtgataaaatggtggtctatgtgccataagggcttaggtacataaattaatgttttattaaccataaaaataaggttaaaaggttgaaatgtagccttcatgtgtctatgtaaaaaagaggcagaaaaaaatcctcagcactctagagaagcttagtctctgagcaatcactgcatatactaatatattcacatataatctagaatgaatgttaaataacaaaaatcatgttcgtttttatattttgctttgcctttgggatacgaagtgatggaacgagctcgttaacactgctcatttctggttagaagaacactagaaccacctagtggatttttcatttattgcatgatccctacactttactattgctaaattgttaattgctgagataggccttaaagtaaaatcagtggttataatctctttgtgggtcataatagaaatagtaattgttaatcttcagcagacaaagctgtccctaagtccttgaagggaagtccctgcccaccaaatacttaccaactagcacactgctgcatctagaaaagcacaggcagagttaaacatttggctgctgagatacaccgtgcaactggagctttaaatttcctgtgaaagtcagtgagcaaggtaaactgcagcaattcatctgcattcatggcagagtcaactttcggtgagcaagactagggaactctgcagagcacagccaaggggctacattagcagcttgacctttgtattcaatataaatctgtgggcacacaaactggcgtttctaatcaattttgtttttggagcaaagtagcttatgtggttacagcgtgccctggtcattctgtttcccattgctgaaccaactgggtctccgcatcttggtggtgatgacagatgttacgtatattacattgggatttgggtcagataaatagcaaatattctgggaaaggatactttatgtttttgcaaaaggttataaaataccaaactttagtaaaccctgattctaggccaaaggttaactctttatatctatgatttattaggtatcaaaagaaaaaagtcaggatctaaggggaatggaaaagtttctgctattctaacctaagagctggttgtcttctcctagtaaactaactgttcagcagatgggatgcatcgggctacaaggttggtgctttccagccggcaccgcgtgtgaagggcatgtggttgggctgggctctccaagtctgcatggcttgggttgactataaccaggggaaacacgcagtggctacaactgcttctcctaacaattctcgtttcattctcttctcccacagtgtgaaggaggctaggtggatattctctggggcttgaaatttcacactgcaaattttacgagagtgatgatctcttcctaactctttagaagccaagataggaaaaatttcagtttacaagaataaagcccaatccctcttcttatgttggaatgtccagtaaaatgctaagaaacgggtgggtagaagaagaggaaaggaagaagagaaacagagaggagagtaaggaaaaaatagaaaaggcagaaaaaaataatgtacatgaacaacaacaaaaatagtgacaaacagaatggactatagagataggggagggtagtgaagggcttcagagaagtcaggtgaagggccttcttttcttttctttttctttttcctttttttttttttttttttgagatggagttttgctctgtcatccaggctggagtgcagtggcataatctcagctcactgcaacctctccctccgggttcaagcaattctcttgcctcagcctcctgagtagctgggattacaggtgcccaccaccatgcctggctaatttttgtacttttagtagagacggggtttcaccatgttggccaggctggtctagaactcctggcctcaagtgatcctcctgccttggcctcccaaagtgctgggattacaggcatgagccaccgtgctcggccagggccttcttttttaaagaaaattttattatgctgtgataagaacacaacatgaggtctaccctcttaaaaattgtgtgcataatacaatactgttaactagaggcacaggttgtacagcagatccctagaatttattcatcttgcataactgaaacttcacccctgttgattagcaatttcccatccttgcaccccagtccttggtaaccaccatttattctactctcgcattatgtgaaatggactattctagatacctcctcaaagtgcaatcttgcagtatttgttcttctgtgactggcttatttcacttagcataatgtcatcaagtttcattcctattatatatgtcaacattttcttctttttaaaggctgaggctgagtaatattccgctgtgtgtgtgtgtgtgtgcgcgcgtgcatgtgtgtgtgtatataatattccaatttacgtattcatccattgatgaacattttggttatttccacatcttgttttttttgaatagtgctgcagtgaacagtgggatactaatatttctgagatcctgattttagttttttgtgtttattttttttgagacagggtctcgctctgttgcccgggctggagtggtggcgccatctcggctcactgctgcctcaatctcctgggctcaagtgatcttcccacgtcagtctcctgagtagctgggagtatagaccaccatgctcagctaatttttgtttattttttgtagagacgaggtctcactatgttgcccaggatgatctcaaactcttagactgaagcgatcctcctgtctcagcctcctaaagtgctgggaatataggcatgagccaccatgccaggccccagtttcagttattttagataaataccgaaaagtgggattgttggatcatctggtagttctatgttttcaatatttttaatttttcccagcttttttgaggtataattgacaaaaattgtatatatttgaggtatactatgtgataatttaagttgtgaaatgattaccacaatccagttaattgacacatctgtcatctcacataattaccatttgtgtgtgtgtggtgagaacatacaatatctactttctgagcaaatttcaagcatgcagtatggtattattaaccgtaattatcatgctgtactaatattggatccctagaacttaattcatcttacaacagaaagtttacatcctttgctcaacatctatttctcctacctctggatctctggtaaccaatttctactctctgtttctaagagttcaacttttttagatttcacatataagtagaatcagacagtatttatctttcttcatttggcttatttcttttagcatgatgtccttcagattcatccatgttgttgcaaatggcaggattttcttctttttttaaagactgaataagattttctttttatgcatacatattgtctttatccattcacctgtgatggacacttaggttgtttccataccttgactattacgaataatgctgcaatgaccatggggatacagatatttcttcaagatacttatttactttcctttggatatagacccagaagtgggattgattttattatatagcagtgttgttcttcactttttgaagaactgccatactattttccatagcaacagcaccattttgcattcccacaaacagtatgcaagggttccaatgtctccacaacttcaccaacacttttctcttttcctcggagctttttgtctgttaaaccccagcttcccccagcctgaagcatagttgacaaagattgtatatatttacagcgtacaacatggtgttttgatatatgcatacattgtaaaatgattcaatcaagctaattaacatagccgacacttcatgtacttatctctctttttttttttgtgatgagaacattggctttttgatagccatcctaatagatgtgaggtgatatctcattgtggttttgatttacagtttcctgattaggtgatgttgagcatcttttcacattcatgttggccatttgtatgtcttctttggaaaaatgtcttttcaggtcttgagccccgatttaattaggttattagtatttttgctcttgagttttaagagttccttgtatatttcagaaattaaccccttctccattacatagtttgcaaatgttttctcccattctatggtagtttttttcattctgttgtttcctttgctcacagaagcgttttagtctgatgtagtcccatttgcgtatttatgcttttgtcgctgtgctcttggtgtcatatctatgaaatccttgccaagatcaatgtcatgaagattttcccttatgctttctcccagtggtttcacagtttcaagtcttacatttaagtttttaatctacttggcattgatttttgtgtacagtgtaagatatggatccaaattcattcttttgcagttggagagccagttttctcaacactatttgttaaagaaaccatcttttgcccattgtatattcttggcacccttgtcaaagatcaattgatcatatatacgtgggtctatttctgggctcctgattctgttctattggtctatagtctgtctttatgccaataccaaagtgatttaattatggttgctctgtaatgcattttgaaatcaggaagtgtgatgcctctagctttgttctttctcaaaattattccggctactcaggggcttttgtatttccatataaattttagaattgttttgcctatttctataaaaaatgccatcgagattttaataggaattgcactgaatctatagattactttcggtagtgtggatacttccacaataataagtcttgcaatccatgaaccaggatgaagggcttctatatatagggcatcagttctcaagattggctgctgggcttctcagagcccatgaagataataatgagacactgttagttaattttaatattttaaagtttgatattctatcttttaacgtttacaggaatttgaaattgtatatttatgtgtgtacctatttgtttcatggctctatgaaggcaggaccatgtctcttttactcaccacagaacaactagcaccactgttgtgcagtagagcctgatggttagagctgcacgcatgggcagacctcccggtttgccatcctgctgcgaccactgactaccaatggcacatataccaccaattggctaggctaacaaacattccaagccccattttgccttgttgccttccattatagaggcttgtacaagaaaaaaaaccctacattttactttcccactctcatgctgctgggggatggtcaaaggacacagacttggccaatgaggggttagcagaaagctggcgaaggattctggaaaggctttgaattcctgctgaaaaggaaaaatgcagttgacagatgacactaccctctctcttcttaacttaaacgtggatgtgatgcttggatataggtccgccattctgtgcttctgagggaaagagtcagtcaattctcagagggagcagctctaacaccgtggagccatggaatgaacactaggaacaaatgacctcccagctgattgttatatgagagaaataaatgtccatttgtttcagccactgtacatagggctttctgttctttttcagcaaaacgctcctattacagcagttttgtgacttcaagcaagttactttactctgttttaatgttcccatttaaaaacagggattataccaatatcgtcctcatagggttgtttgaaagactaaatgagataatatacgtaaagagcacagagtaagcactagatagggataaattactatttttattactattttgatgatgggctcttaataagtcttagatgaataagtggagtaggtcaaacccaaagggtatggcttcaacccaaggcaacccaaggcaacccaagataactcatttttttctgtttgagaaaaatgagaaagggtggagaaatgagaggaaggtggggtgcggggaaggaggcagggctaaagtggagccaggtgggtgctgggtgggggggaaaatgccctatgaaaatctcccatggtgaatggtcaatgtgttggggccaacatattggccatgtgtggtccaggcatgccagtatcaacagacactaaataaacattttttttttttggctcattgaataaatgaatgcattgtgagggtgttcattaacaaagaaattgccatctcatccttaaaactgaagagatagaagtgagagggcagaaggtttttctccagtgtcactcgcacacctattataatatttgcctggaattatgtgggtgaagatgcattgctcaataattgcctgtgccctcgcaaggagcagaggagaacatccggtgggagcagaagcagaggcagaaagaacagatttcccacggagtaaaatattctgttctcataaaaagtcccttgctgtaacaaacgagaaaatgaaaaggagagcctgtagaagagaggcagacacctcttaataggcacatctctccaaagtttcccaccaggggccaactgttcattaaacagggaacaaatgcgggagcgtagctgtgatgggctccattccacagcccagtgctgggactgcagtgcgctaggaagggcgtcgctgttgttgctgtggcccggtgtgacagcaggtctggcatgtcagaatcgccctgcacaaatagctcctgtgcagctgctctcacccaaacctgctctgaggaggctcagtgcattctaatccttcctaaaaacatggacagaaagcaatggaaagttgacatgtataaaaggtttagtcatggggtttttaagtggatgcctccatgaaaggatcaactcagatggccacgtttctgaacattatttacatcaaaacctgacataaatgcctcagatctagctattttcttcctctatcctctttttacatgtctccttttccctctcgattgctttagcttgtaacctgcatgcgctttcaaatgtggtaagcaaatagaaagcaagacgccatttgaatagtgaatggacttgtattcctgtttaggaatgtgtagttgcccttgggctttctcagttataagactcataaaataaaaccttaacacagatggaacacacacacacacacgcacatgcaccacttaaagcagatgtgagtcaaaaacatatgctgatgaactcaatttgctgatggcattctgagcagtgagcccactcagtagggctgaagggttggcatagcaactcttcctgggaaaaaatagacagctggaataaaccatgacgatgaaagtcttcttccaatgactgaagaagtagagagaaattgccatctcttctaaccccttcaagcaaagcaccttggttgaggtttatagactaggatcttacaaattagaagttcatgtattttcctaggtcagattctataccttgggttatattccagctaagaaacactttcagataggctgcatggggctgtggggaaagagagagcacaaacctccaaaaagcatggagctttgaccaaagtttatttctgtaacttatcctaaggctatgccgagtgaagacttgtttactctagctgtaacttactccatcacatagcaccattactttgagaaattaacatattcattctcaattatttatcaagtatccagcactagcaatagggacacagtccctgcttttgagggattcatgactaggcagacagcaccctgagtatattaattaagatctgatcccatattagaataatatgcacaagagacttattacctctgtctcctcattcctataaacatttatctgggacctatcttatgtggactgtgctaggtgcaatgccaagggataaagcaagttaaatggcaacagtcctattcgacaggccagggactcaggatcagactcaggaccctttccctcttgttgcaaatcctgctatgtgtgggctcagccccaaactgtctctgaaatctcagaaatgagcaaaggctaaggatgtcaaattggctttgagatatgcctgtagactgataacaatagtgatgatgacgatgatattagttaatacaataaagctaatactgtgctattattaccaggcactgttctaagtactttaaataacttatttcatatactcttctgtcatttagtatgcataccattattctccttcccattatccatatgaggaaagcaaggcactgagttaaaacgactcacctttaactgttcatctatcaggtaagctaaccccggagcctacataaattcttaactattaaataagctatgccacttctcaaccactctgctgaaaactatacaaactgacaggtcctacaattaaaacccaaaatagatataataaagcataaaaaatcagttaggaattttctcttgcttttgctctgctgttattgttgttctccagataagtcccattttaaaatccacagtcaccttaaggatgtgatgtgggagctggagctgtctgcctacccaccagctatttttaaaggaagatgatcaggaactagttatgaaagaatcagattgtttaatctggtaccacagaacttgagaaactatagacttggtaagttggaaaatatgtaggcagaagtgatgtctctatggaaacagatgtgaagattcaagtaaatactaggcctgttggactttttatgaagatagcagaagcttttttccccacttcttcttctataacctgtttattgaggaatctgaccatggtgaggaacaagctagagacatatttttatctctagtcactgcttccaactctgctatgtcgaatctcccaactcttctagacatctctcaatgacatcttggacaggaaccatagtcacttacagtctagtccagccttatagcatatgcaactgcatatccagttcaagattttccattgctccattgatggctacacttattactcaaggatctactgtgggtgtgcttaggggtaactctttcaccttggagagtggtgtgggaatgttcttgttctagtatacttcatcccaaagacccaattcctcctgttttggggactgggagagaagatgagatggcttaatgtctcttggctttctctattgcttttgctgtctctctagcataccctagcgaccactgagactcttgtggggcagagatccacacgttatctatcttagggacatgatgggttcttcgaagtccctcatgagaggcgtgactctggctcaaacatgttcagcccccttcagctgtccaagcccccccaccctctatcagctctaactacactgcttgcatttttctttcctggtgggctgctttactggcatgtggaggagtgctgatatagcaggaagagttttgctacttcttattaagtcctgaaaaggtatctggtgggtgctgtgtttgtaataagatacttagcacctgtttcccctcgagctttgggcctaggtatcagttctcagacaaaaggaaaagtcaatttttataccctattataatgataaactttgattgaaactttggggataagaaagcatcgagatgtttctctctccttctattcctcttttctcctccctccctctctccctccttcctttgctcccttctttccttcctttctttcttccaaatagcaaccatgtaatctaaattatgaatgataaaaaagcctggcaaatcaatgagagaacttagagcaaaggaatttggaatattataagatagggaacaattttagtttcctgagcattttggttgtattaccacctgctccaatcatagactgtactttttcatgcccagaaaagacttctacaacccagccttcatagcaatcagccactcgggactttcttgcagtctgagctcaacctgtcttattttgctctgagttttccagttctgaaggcttgattactggtccaagagtgtcatttaggtagatatgctgaactcacatcatcctcgttacaaattgttatggaaaatcccaaaaatataaaagaaaaaaattttaaaaactagctaagggcactgttcacatgctgcaagatctcacggaggagaagatggaatgagtggaggatacacttgctgtgtgttcatcattgaagaagggaaagagcttgtgaaatgacccctagcagaaactcactggtgctttcaagttcagggtggcagggttgaaggtgagagttagcttcagggaagatggtggagaagaatgtttgctagtatctggaccccaaaggattacacaggatgctggagcctgcatgggctaggaataccattagttcaatcatggtctacacttggcaaggaagatgcattgagaataggtgaagggcatagtcaagaccaatgctaactgtcattccttatggaggaattatggaatctacttcaggctgccatgaaaagcaaagcagagaatctgttgggacaactcgttcagcagcctcagactacagctgcatctttacttatctaggcctctagatcactcagaagtaaaggaaaatttaaacaaatctaaacattctcattctttcactggggtcttcaaagttttgaacacaatctctcagaagaatcaatttctgatacctgaatctttgtaagcacgaacagagagaagggactggacagatgaaaaggatttgtagttcaaagaagagggccattgtggggaactgatgctgagctctcggttctatgccccccagacttccttcttcagttacggtccctgcagaatcagcatccatctgcgactctcctttattcattgaactccttgttttggagaggagaggcatattttctactttatgtagctctccagcccatgatctcctgtggtcaggggctaaggattcctttccctgtttcctagtaatgcataactctatctctccataaggcagggtgggccaggcattcagaaagttggggaagctaggcagaatgtgaaataagtgaagggaattgaagggtgctggaaaacctcccatcaaaatttcctcccccatgttattccaccattaggtaattagctccctggttcttaaaggattacatcacttttctttgttaagagttgagtcatctatgcaaaaaaaaaaaaacaaacaaaaaacccaaaaactgagtgaattaaaaccagaatccttattagttattacctcaggagctttaacagtgtcccacttcaattagagcaaagctcactgggaatgtgtgtaggataaagaagatgttggaggtaatagacattaaggaaggggccaggagcgtggagggaacccaagagacgtgggaggatctcaaaagtgatctttgcctattgccaactgtgactgaggccctggcccatcatttgatgttctctgtcattcttgggagaggcagaggagtgtgatgattaagagcatggactctaaagctagacttctgggttcataaagggtaacagcttagctctgccccttcctaccttggggactttgagcaaataatttaaccgctctgtgcttttttcttcatttataaaacaggagtaatattggtccctgcctcaaagggttgttgtgaggattaaaggagttaacacacataaaatacttagaagagcacatggcatagagtaaatgctagttgttattagtatgctttcaatttcacaaagggacttaaaaggtcagaacccttacttactcctaggaaccactggggaaggagtgaggaccaacatatattgcatatgtatgccccagatactgtatataaaatatctcattgaaacctcacatattgatgaaataggtattacaatatccctattttgcaggtgagaaaactgtgtctcagagggtgagaatctggcccaaggtaatacagctaaaaagtggtaaagttatctatgatatcccacaatgttacttacacagttctctttggaaataaaaatataaacaaatggtacaggcagattaagaacaactccagcattattattattattattattattatttttttttgagacagggtctcactctgttgcccagattggagtgcagtagtgcgatcatggctcactgtagccttagcctccctgggatcaggtgaccctcccactttcaagtagctaggactacaggtgtgagcttttgtttttttttttttttttttttaatagaaacagggtttcaccatattgcccaggctggtcttgaagtcctggcctcaagtgatccacccacctcggcctctcaaagagctgggattacaggctccagcatcaaatgtttacagtagttgtcctcacagaaaatgcatacataactcttatcttcctgactcaatgctcaccttcacctcccaccctgactgcagcctattatccctgcagtcagtggacttttaatccagataccttggctgagcaggctcatagaggaaactggcccacagaaactgtgagaaataaatgtatgttgtttgaagctgctaaatttgtggtaatttgttatacagccataaaaacgaaaagaccaaacagtcatatcctgaatgattaaaaattggttgcataagtaaaagaatgtatttgagttggaagatttggggttttcacatgaaaaaccaagtgtgagtaaaataaccgcagaatagctattttggaattctgatactcaaacacttgctagttgaaggagtgctaagattatggatataacaattgattctagggtttcaaaacttatttcccataacataggaaagctgaaactctggctataaagaaaaggctatttttctttctcttgaaataatttgtactattcattgcactgtcaatagccaagaacatgctagaaattacaacgtgctcgcacatatgggtatttctgctatgatgcaacatatatgtttctaaaattcattttgttttgcaaaatcaaccaatagaaaaacaaaggacttataagaaaaatagggttggggcacaatagtcacaaactgtcagtaacacaaaacaaaaagataaaatctaatcaaattgtggtagcacagtcttacacaagtcaaatgggtaagaaatatgtaaatactacaaaaataagacactttcctttgacaaagactttacatttgcttgtggaagtgggagtcagagcattgcagcttgtgagtttttgtgaaattgtggaaggaaggtgatttgaaatcaagggaaagttgtatcactgatgtggatggatatggcccatgttgagggtggtggactgaggtagctgacatgtttcaggtacgtgcatgtctgttttgtacatcttacctggctgggttcaggtgtgtgcaattttctgtgtttccctagtgtttttcatagactaaacagtgcataagcaaccccaaattcgtgttatgctcaaaatgttctctaataaaatcttgtgtcttgaaaacaagtgttaaaaagtaaaactgaccagatgttatttcatttgaatcttacgataaaagcaataaatagacatgaggaaacagctttagacatagagctagtaaacagtcaaggcagattgaactgaggtcttcctcctctgtgcttttcccattaggccactccaggaatgtctcagtctagcatattttaaatctgtgtgatgctatagtttcactactgcaatttctaagactttatattttcaattagacatttattttactaccaagaagtatcctgatccagaggtactattctcccagccatggagagttcctccaaaagacaaaattctatctttgctaatgaaaatgcaaataaaactgtatcaagagtttcatgattttactaggtatttcccatcatatgtttatcatacagctcaaaattgatgtcaagttttttactctactcttttctcaagttcattcactataaattgaatttcatttttctgcacttgggttgtattttttgaaccactgactttgcttatattagttttactatgatattcatcaatttgtttaaaaaaattcagaagatacctcttgcacaaattcattttataatttaagaactcacttcagaatgttgagactctgttaagtatcaattctaggattatgaagatcctgtctaccacaaagagccccacaaaggtcttttctccctcattcccaagcagtttaacttaatgaattcttctggtagaactttgtttagacggacttaaagcaggtaagagttctttttaaaatacttgtggagtgcatgagtgtgcaaacaaacttaaaagcacatattggctcaggaaagctgaggggaaatgataattttcaacagtccaaaatagccatcctggggcttacagaaagtaaggtagcaattagcctaactctaagcctaacaataacacagtcattaatcctgggtgcccagacacattccattagaggattttggcaacaaaattttgcttttctaattctgagtagatataaacaataatcccttaatttattagtctgtttatcacacttattaagcatttcctatgtcttaagaactgtgccacaagacaaggatgccctctcttaccactcctattcaacataatatgggaagtagacataaacaataattccttaatttattagtctgtttatcacatttattaagcatttcctatgtcctaagaactgtgccacaagacaaggatgccctctcttaccactcctattcaacataatattggaagttctggacagggcaatcaggcaagaggaagaaataaagcgcatccaaacaggaagagaggaagtcaaactacctttgtttgcagatgacatgactgtatatctagaaaacctcataatctcagtccaaaagcttcttaagctgataaacaacttcagcaaagtctcaggatacgaaatcaatgtgcaaaaatcactagcattcctatacaccaacaacagtcaagctgagagccaaatcatgaactctcattcacgactgccacaaaaagaataaaatacctaggaatacagctatgtagggtggtgaaagatgtctataaggagaactacagacttacaaatcactgcccaaagaaatcagagatgatacaaacaaagggaaaaacaatccatgctcatggataggaagaatcaatattgttaaagtggccatactgtccaaagcaatttatagactcaatactattcctatcaaactaccattgacactcacagaactagaaaaaaactattttaaaattcatatggagccaaaaaaagaaaaaaatccagaatagccaacacaatcttaggcaaaaagaacaaagctggaggcaccatgctacccaatttcaaactatactacagggctacagtaaccaaaacagcatggtagtgacacaaaaacagacacagagaccaatggaacagaacagagaatccagaaataagactgcacacctacaactatctgatcttcgacaaacctgacaaaaacaaacaatggggaaaggattccctattcaataaatggtgctgggataactggctagtcatatgtagaatattgaaactggatcccttccttacacgatatacaaaaactaactcaagatgaattaaatacttaaatgtgaaatcaaaaactacaaaaaccctggaagacaacctaggcaataccattcaggacataggcatgggcaaagatttcatgatgaagatgtcaaaagcaattgcaacaaaagcaaaaattgacaaatggggacaatttaagctaaagagcttatgcacagcaaaagaaactatcaacagagtaaacagataatttacataatggtagaaaattgtgcaaagtatgcatctgacaaacgtctaatatccagcatctataaggaacttaaacaaatttacaagaaaaatacaaacaactccataaaaagtgggcaaaggacatgaacagatacttttcaaaagaagacatatatgtggccaacaatcacatgaaaaaagctcaacatcactgatcattaaagaaattcaaatcaaagccacaataagataccatcttacaccagtctgactcttactataaagttaaaaaataacagatgctggtgaggttgtggagaaaaaggaacacttatacaccgttggtgtgagtataaactagttcagccattgtggaagacactgtggccattcctcaaagacctaaagacagaaataccactcaacccagcaatcccactactggttatatacccaaaggaatataaatcattctattataaagacacgtgcacgttgcatgtgtatgttcattgcagcactattcataatagcaaagacatggaatcaacctaaatgcccatgaatgacagactggataaagaaaatgtggtacatatacaccatggaatattatgcagccatataaaagaatgagatcatgtcctttgcagggacatggatggagctggaggccattatcattagaaaactaacacaggaacggaaaagcaaatacctcatgttctcatttataagtgggaactgaacgatgagaacacatggacacaacacacactggggcctttcggagggcagaggatgggaggagggagaagatcatgaaaaataacttaatgggtattaggcttaatacttgggtgatgaaataatctgtatgataacccccatgacagaggtttacctatgtaacaaactcgcacttgtacccctgagtgtaaaataaaataaaataaaaagaactgggtgccagatgttgaaggaaaatagtaagatcttaagaaaatggctttggccgggagcagtggctcatgcctgtaatcccagcactttgagaggccgaggtgggcggatcaggaggtcaggcgatctagaccatcctggctaacacgatgaaacaccgtctctattaaaaatacaaaaaattagcctggcgtggtggcaggcacctgtagttccagctactcgggaggctgaggcaggagaatggtgtgaacctgggaggtagagcttgcagtgagctgagatcacgccactgcactctagcctgggtgacagagcaagactccatctcaaaccaaaaaacaaaaaacaaacaaaaaaacacagcttcaagtttgtagatctatggtcattcagtctatgacactgaacacttcctttagtagctcacttgttgaataacatctagaattaaataggagaaaaaattttcctaatagaactataccaggctttacatgattggtagtcttcgttcttcacaaaccagtttattttaatagatatctcaggtagagttttatgaaggcctcaaagcaattaaaacttcatttgcaggaaggacaatcttatacttaccagaaaactacagctaacatgaatttctttgttagacatttgctatgaaggatctttgagaaaattctgtgttagaacccatgacacccctaacatagctatgccattatttttttcttcttaaatgaacagatgagttttgtaagcaaagtaggataccatgattgatagacctttttgtaaagtatactcagatttgctgaaagagcctacataattcagtctgggtgcagtggctcatgcctgtaatcccagcactttgggagactgaggtgggtggatcacttgagatcagaagttcgagaccagcctagccagcatggcgaaaccctgcctctactaaaaatacaaaaattaaccaggcgtggtggcacatgcctgtaatttcagctacttgggaggctgaggtaggagacttgcttgaagccgggaggtggaggttgcagtgagccgagatcatgccactgcactccagcctgggtgacagagtgaggctttccctctctcaaacaaacaaacaaacaaaaaaaacaaaaaagaaggagattacataactcaagaaaaccatactcgaagcctctctttttaaataatttttatctcaaataagggaaaaatcaaaatggaaagaggttatgatcagtttcaccattggcctacagtattgcttcagagaacaaaataaaagggttcttgcctctccccttgctggaactgggcctgccccagggacttggctgtagggttgcaggtactttccctgtcctttgatcttaatcaccaagggagcaattaaagttccatgtccaggaatcacttagtaaagagtcttgcttttagttagagagttgaaggggttgtgggcaatatctaaatatgctttggacattgtatttgatggggttgagaaataaaaaaaaaattctaggctcctaactaactgaatggattcccctcttggccaagggtgaaactgcctttgcaaaattattacacaaagagaaatctaacatagttgactccatcttgcttctgacttccaagctgtccttggtcattcctgggtgtaggccaagctcactttgggaggaatttagtttatagttttaccttaaaacaaagatgataatagcccttctcaaaactaaatcacctttgtaaaactaatggaaaggcacaaggttaaaattatgagagaggcccgaattctgataggataggcatagtttttatcagcccttacagatcaggaatcatgtgaccagaggtcacaagatttgtgaccttcccatttactcctatagttaacattgctatgttagaacccaagattgtattttgtgggggatgttttccagactgatcctacctgaacttgtgattcatgactcaattgatcctatggcctcacccagaggtagactcagcatacgaagactgttttccataccagtatgattccatccctaaccaatcagtggcacccattccctagccccctgcccaccaaattgtccacaaaaaccctaagctccaagccttcagggagactgatttgaatgataactccagttctcccacgtgagttagctttatatcaaatgaactctttctccactgcaatactgtggtctcagaggattgatctggtctgtgcagtgtacagtgctgggtgattaccagagaaactcgggaagctgagttcatggccttggcgggatgggaggttgaactagtctcactagtatgtaatcacttgtctcactgctgtcccctccccaccttttttaaaggaaaatgtacaaatagtaaacttcctgagaccctctttggaaaaaacagccatagatgcatctgtgacttatgtttttcctggacatgccctcaagctggctcgataaaccttgatgactgagatttatgactcagtcactcattttgattgtcacagtataaagggcctgctatggtctgcatgtttgtgtctctccaaaattcacatgttgaaatctaatctcaaatgtgtgggcattcagaggtggggcatttacaaagtgatgaggtcatgagggtggagcccttgtgaatggaattaatatccttctaaaagaggcccaagggagcttgtttgccccttctgtcatgtggggacacatagtaggcaccatctacaaggaagggtcctcccccagacacggaaactactgttggtgccctgaccttattaattatgattgagacaatcaaatatggtctggctaagagaagaatagtccataacattttgatgctgactccctaaagtctatgttttgaaatattgaatatttaacatgaagagcaaattacaattaggacgtcttaggtccatacaaagtaatattctatggactgcctttggaattactaggtttggtcttgggatcagattgaatgaactcagtatagattctgtgtcacttctactcatgaaacacatttactgatggttaatctaagagtatctttaggctaggtacagtgcctcacacctgtaatcccagcactttgggaggccaagacaggcagagcacctgaggtcaggagttcaaaccagcctggccaacatggtgaaaccccatctctactaaaaatacagaaattagctggatgtagtagagggcacctgtaatcccagctactcaggaggctgaggcaggagaatcatttgaacccgggaggcagaggttgcagtgaactgagattgcgccactgcagtccagcctgggtaacagagtgagactccatctcaaaacaaaaaaagtatttttatatatggcaacatgttgctatatagttatgaaataaagtgttgacaaaacttgactgaatgtaatcatagtgaagccaacgttatgtgtcatatgtcacctgtgcctgttttgtcacaagtgctctttacaaaccacttagcatcttcactttgaggttgtatgctcttatttaatgctccatagagttttgagattgttgtgagttttctattcaacattggcttctccaaagatttgatcattttttaaaacagctgtaaacctattcaaaatttatataacatatatttaaaatataaggacgctttctgatttcaaatgcatctcatgcagttaataaaattggtaattggtaatttagagtcacagataactctaagtaagtcaattaaaactgtgtaagaatttgaaaagaggatacagggcattgaggggattgacatttggtggccaagtcattatagctattgtttggaagaatctgatgatattcaaatgatcaaagcaagtattttgaagaaataaatgatgtgaaataactgataaagagatactttaaactgacattatcctacacttaaatataataaaaatacacagtaataaagcaaaataacagatttgttgtttggctacaacatcaagtcattctcaactacatattttgacaatagtgactctaaatattttctcaaactaagctttcctaaatattttcccaaaccaagctgtttctttacggactttatatgcattaattttatatgaatgactatttttctaacataaaaacaatctttacaaatattttgagaattcaggaataaaactaaagcattcaaatgaccactgctcagttgtacttgagagattttgcccaaaattatttaaaagtgttgaactgtagaaggccttaaaatagaacttgtagaatttcaatattcagaaagtaaagtttgttactatgggtcatactgttgtgaaaaagcagaaaaagaattcagaataatcaaattgaaactattttgctgatataatcaaatatgcctgatgtttgttgtggttttaaagactgtattttctctttggacatttctccatctttctttttttttttggtgtaaaatatacacaacataaactttccctttttaactacttttaagtgcacagttctgtggcattaagtacatctacactgttatgcaaccatcaccatcatccatctctggcactttttcactattcccagttgaaactgtacccattaaacaccaacttcctatttttcccttcctcagcagtcaccattctactttctgtctctgtagattgactactctaggtaccttgtacaaatggaatcatataatatttgtccttttgtgactggcctatttctctattgttttactaacataaaagtattttatctgttattaattttatctagtcagaaactggaaacactgacagaatctttggctgattaattacactacaattgacaaaatactgcccaaacataagtgatttactaaaatatgggacatgatgtttaaaattaaaaacctgatgaaactgtagtgtcagtctcaattgcagttgtaatatttttcctatagccaatgattaaaatgtgcatttgttagtgattttaaattaatttatattaaatttactattttcccatctaaagcagaattaattggtcatttttttggcacatgaattaaaacatatatacactgtctttggtttgctaaaagaatgaatgaatgatataaaggcatctcatgtagaaagatttgttcttgttaattagcaggtttattagaatatggtttctttcatctgaattttggagattggaaaaacaatctccaaaatataaagaatgcagagaagtgcaggagaagagagaatggtaagctaaaaattaccatcaaatgctaagtgtcagacctacacaaacacaaaatttaacatacttaacagtggcatgttcagtgaatatgagcaggagacatgagctcaaatctaatgatatctatgatgccagaaactttgtatatgctgaatttaatccttatgacaactctctgagtcatataatttccccatttttgcagatgtcaaaactgaaggtaagaaacggtaagaaatttgcctagtctcaacactagtcagtgtcagagccagaattccaattcatgtctacatttccaaagcccatgttgttcccatgacacaaaattgtagcatgccttacacttattgacttgggagagttttttttcttaaaaatatagtatcaatataattttagcaaatcttactgccattagaaattggtaacatttatttgaggatagacttcaaaatctttatgagacataagaaaatgaagttccagaataacaggaatttgaatggtagttttcacctttcagaggatggttttttgggggtggtaagaaacatctaagtattggttctcatttgggggcatgcttagaggcatcagtagtttctggtaaagtaagggtctttcaaaagaaagacaaatgaatgatactgtataggtgcagttacatcataggcaccacaataaggtataaaagtaaagcattatgactttcaccttgggaaagaactttgaaatgaggaaaacaaaattgcccaataaaggtgatattttataaccaaccagtgtggactagtggagcataaagtttctttaaagacacaaaatagctgtagcttggattgcacatgtggatacatcaaaataaatatgtgtcaatcaaaagtaatatatgagagtttctgctttggcacattctaacttggtgttatcaaccatttacatttttcataagctaaatagtacgaaataatctcatacagtggttttaatttacagttttctaatgactagtgatgtggagcatctttttatatgtttatttatcatttgagttttctcttctgtgaactgacagtgcatatgttatgcaaatatccaaccttcaatgtccaattttgaagtcttctaatagatgtgaaatttgtgtatagattcttttgaactctacctagacaacatgggagagacggagatgcttaccaaacccattctcttcttcccaggcacacagttacagcgtgtttccccatctctcagttgttttgccatgtgacggactgaattctagaaaatgtaatgtggacagaaatattgctatacctattccataaaacttcccacaactgaaccttcattgtgttttaccatttaccagctggttggagaggatcaggatctaaagggggtcacaggtgagacgagtaatcatgtgaaaggctgcacaacagagaactcccacattggactataatttgaatgggaaattaatctattgggttaagccactgaaaatttgaagtttatctgccatagcagctaatattgtcattaactaatatacactatgtatcgttgtgaataatgactattttgtttcttcctttacaatctctatactgtttatttcccaggagttgacattttattatgttttgtttctttcttttcacttccccgccgtgtcacctaggaactctagttcaatgttgaataaaaaattttgaaagtggccatctgtgttttgttactgaatttcgagggtatgttgaagtttctcttttaagtggggttttcttttcttttttttagagtcaggggtctctctctgttgtccaggctggagtgcagtggtgtagttatagttcattgcagcctcaaactcctgggctcaagggatcttcctgcctcagcctcctgagtcactgggagtacaggcataagccaccattccttaagtaggtttttcatacataaacttaattaggctaagaaattttccttaaattcctagtttactaagaaaattttactgtaaatctgtattgaattttgtcagatgttcataggcttgtattaacatagtaatacatattttttggcctttaatctgttaatgtaatgaattacataacagacttttccaatgttaaactatcgtacattcctgggataaatccccttctgtttttacatattattgttgtctaatattttatataatagttggccaatataccaatgtttgctatactgcttttatatcactgttattggttatttttttcattcttgatttacatggccaatgttcatttggttttacttacatatttaccagtttctttactcactactgtctctttcttctcactttttcctttgagttcagctttcttatttctgaattacagtcttcacagttcttcagctaatagcaaagttttaaagtctttttctgacaatgccctttttcattcttattcttgaattttagatagctgggtataaatcctttgaagacactgaattctattctgaattgtattgttgttattgaaaggttcttcttcttcctcctcctcctgctcttcctcctcctcctgctcttcctccttctcttaggtaatatctttgtctttgtttcttctttagatattctctttgtctttgatgttctgtgtttcaccaaggatgcactgtgtaatggctctagttgtgagtttctttttatttaccctatttaggattcttgactttaatcaaatcaattaaagtgtacttttctcccattcttttaatattctctatgtggaattcttatgagacatagattaaacattacttctatgtctctttttaacatatctatatacctctctgtgaatatgcacacacatacacacatatataatatatatatttgtatatgaatattacatatattttgtgtatatattatagataaaagtatatatacatgtgtatttatatgcatattgcctgtgtatataaaattaatcatatgtaagtttaatttctatataaattatatataactttaatttatagttaatttaattatataaagattacatatatatatttgttgtgttttgtttttacttgcagtgccgagaattgaggtaatcatgttgctcagttcatggcacactattgttatcagtgggtgtactatttctcccttggttgtttgtttaatcattcctctttattctcatttcccacttatattttccttctcccataggaatctaatgtatttgttagaataagcaacagcacagtaccacagttgtataaattaaaatatatacccactaaagaacattatgtatttttaaagtacctatttctcactttctatattcagcattctgttttaaagatctatatatgttgctgtatatttatctagttcactgcttctaactgctgcatcttaatatataatgtgctgtcattgcatttccctgattcactcttcagtgctggaaactcagggaacttccaacttcctgctgtgcaaacaatgatcaaataaacattcttttacatgggttttatagacccttttgagaatttctctgggatgtattcctaggaattagattgattggtcattggatagacatatttgagccttatcctcttatattttgcatcttttgctgaatttgggatagtttcattaaattgatcttccagtttgtattttatatgttttaaattttctgtatattatgatgttttgacatcttaaaaaaccctttcttgctgtaaagagaccgcccttcctggctctagccaattcttagagatagcaaaggactcagttaggagcgtactttagatttgcaaattaaccaagttgtgtatcttctgtgtggcctgtacacccccagggaaaaatatgcttgtgtcttaatcatcccagggccatgtaccaggcaattagggactatctctatagtttagagcctgcagttattattcaaactaaccaattctaagaagtttatcctgccctccctcacgcttcctgtcccacggaagctccaataaaattctagttttggttttcctcttacttctgtcttctgccacctgaccaaaacctggtgattccccggtaactctgtatggcatgtggtacccccctctctagaacctgtgaaagtaataataaactttgttttcttgtggctttcctgtgtcccctgtgctgcacctgattaaccatcacctaaaagaactcagaatacgattcatacattttctcttcatctgcctctaatatgatatttttaaaatgtaaatgattagaagctctatttgaggataatagattgagaaaatgattgagcagaaaaagtaaatcaaatgagaatactaagacccttcaaaaaagatatggcagaaattcttcatgtgttttacaattttagaatgtaaactcataatttgttttgagttcatttgaaagaatcacatttgtaccagtcatgagttgatcagaaaaacggatcgtcatgaatgaaatagaatagtggatttaattagaccttgtacaattggggaactggttaagaagtccatgtcaggctgttgctttttcatgtggtatttactggacctggggtcactgtagataagctggaaggcaatcaggaatgagagttggatttgaaataggaaagggcaaggacaaactggaacccacaaggtcagacgggaaccccagaagacaaaatggagcccaccaggacaaactggaatttgactctgtctctcatgatctctaacttcaataatgttagtgacctgcagagaagtttgaacccttcatcctgaagttgcacatacacttggcccaggactgaaggaagtcaaagaaggaaatccactggaagctggagaactgtgggtctaggtgcttctcagtgtcaataaggtgggttaatagattagtgacaacatgtgcaaattgccaatgcctggtgtcatatattgagtttcagagtataaaatggtggcttcttcatttgtgcccttcagttcccagaccaatgtgctttatggcctactccaaattgagaaacacacaaagaaataaattctgagaatgtaattccagtttagctaggttgacatagtataaaaccatattacactagtttagttgaaggtatgtatctacggatatattttgtgtttatttcttttaccacccttgaagtatctccagctttggattaattttaatgtaaatttttcattttggagctttctagaccaatagccaaacttaaaatgagttacttgacagtggttctgggttctcaaggaagagtctctatttcgccattctgaacagaggctgagaagacaacttacccagttatttccctatacctatgggcatattagttcacacttacgctgttatttagagtggagtttctctaggttctagactctggtggtctctgttccaactccctataggagtagggacagacgaccttatctcctgcctcacagtggatattaagacatcagcctctagattacctaagacagcccttccccagagtagacaaagagtcagatctgggctttactgctgtgagtttcagttctctattattctctgtcccctgaagagctatttattttccttctagttcagaaatgcattaaaaattaaaaaaaaaaaatctagatttttcagatgtttttagttgacattttcaggctaactactctgccatgttacctgaacagggagtccattgcatttgcaaccaagaacttaaatgcagagacctcttttacaaggatagggtgctttagcaaattcagatttacaggaaagaaaattacaaatatacaaaacagatcaattagagggatgaatttgcataacaaaaggactcgccataggactagttaaaatagctaggatctaacagtgaatttagagcatctaggaaaatgtgcattgtataaatctatcaggcctgtagttaaagaaatgcggggatgaatccttttgtaaagcagaaagtcctttttgtaatgtgaatgagtactctctaatttacaagtctgtaagtttgagaagtttgagtctttgtgtatctggcttctcaaataatagagatccagaataagttatttatacagagagttcaggtttaactctcctgagtatgatttttctatgttaatataaaataatcaaaacaatctgcatatttaaagaatggaatcatgaggtccttcagacgtttaatatgtgcatttctacataatttcccatgggtcttgttactggaaatatgttgaagacaaatgtttccacaaaatgaccgatttcttttgatagatctatttaagcacacagtaaaaaacatcttgaccagaaacataattgctaattcactgtgttggacattagctattgagttattaaccagttatctgagggcctaccatgtgctgatcagagagtcagagttccttagatatcaggtacccaaactcttcattttccagatgaagaaactagtgatgtcaaatgacttgataaacagtttcatggctactcagaggactgcatgaaacttccagcatattatactgctttctttaatagagtgaaagagtccactaaattaaagaggttgtcaactccatggatgagaaatttatgttaaggaaccatgactcaccccgaagggtgccagactgagtctgtggcccagtgcaaagggcacagagacatgccatcagacaggcttgtgcctgcatgtcttgcattgacgttgggcaatttattaacttctctgaactgcagtttccccatatgcaaagcagaaaattaatactcatcctgccatcctgaaaatgtattgttagaaaagaacattattatatgggagatatactttactgtataaactccaaggtactttaaaaatgtcatttgttatgattattgccatagctactctagagaatgcatatatcaaaagatctatgaactttcacaaatatttttgcagaataatcaaggaacaagttgttaacctttttctcagaagcaataaacaagaaaaatctagactagatgtttatacaaaaagttatttacaattcagagctgtgtccaatgtcatttgttatcattattcttatatgagtgaattaaatattttttaaaaaattaatacatggaaagcaatcagaagaatgatttgcacacaacaaaatgtatatgaacattggttattgttaattatatcctcatacttttctattcctcctgcaattgtgcaagccaaactctctcaactctgaattttattttctattgtttgaaatgacaaagatcatgggtagctgataattcaagcattgtttttgctcaatgggaagactaagatgttgctttagggagtaaaagtatggggagacattgtaacaacagctatagtgtcaaaggacagtgtgtttttaaatgtatgtatacattatacatttattcccacttagcttctgttataaaagtcctgagacatcttctgggctttgatctgtttatggatccagatggcagagaggtgatgagaccacaggttagagagaaaatttagtcacaagattggaaattataagccttttactgcttaattattcccttcctgaatttcaggatatggtcacctatgaaggttattttacttcaatcaatccttggatgaagaagacaataaccatagctgtacaaaagaataatgagatttaagtattgcaccgatttttacctacattctctaattgctcattacctaaggcagctcagaaatgacgaactggctcctttttcatggtcaggacagctgcttttatatgttacatacttgtttaatatgaacttcaatggtttttagaagaaggaataattagaacaggtacagccaggggatttttataactcctttaatgaatactaaatagtattttatctttaaaagggaccatggctgcccttaactgcaaccaagttcattaataaaaagttttcatgcagcagacacaaaacaatataaagaaaccagagaaaaatctaaactgagagctgtagttactatctgtgctaagtgaatcaagcctacttgcaaagatgcataattattttttaataaaaaagaaataaaagattttgctggcttaaccaacgataggtaatgatactaaaaatgacatgagagtaggatgctgtatactgattccagctgcttctctttcgagttgggattatctgaattggaaaagaaaatccccatttccccagcaaggtacagattttacaaaacagagatccatccttgacatggtaaatatctaatgaaaccacctcttctttccatttttttcccaccctgagccacatgctgtatattaaataaaggactcaactttgttcgtactggagaagttgtctgggctgctgcaggatggaggtttacctgaggttacctgtatgaagggtgaattgctcacgctttagagcactgttatctttctccccatgtactccttcaacagcacaatctacagtgaagtacttgtcagggtaagcggtgaggaaagtgagagcaggttgatcaataaaacatagactggaggaagcctcttccacaggaaactaacaatgcataagaagcatattcttaacaatgtttggcaggaaactcagcagcatgaaatgtacttaatgtttaacagaagttctggaagaaggcagctttacacgtgacgtaaagaagattgactgaaggcatgctggggtctctatggaaagagatttggatgtgaatagacctgggcttgagccctggctccaccatgttctcaatgtgggaatgtgtgtgagttcctgctcctccccttcctctgctgtaaaatgggaatggtaacacctgccttaccagactataagcaaacagtgatctgagatgtgtgaaagctttgtcaactctaaagcactattaaaatgcttcaggaaagtagagggaatttatcctggtcacctgccttgggaacagtcacgaaaccataatgtgttcccagtcctgacactggcttccctctggctcaaaaactgggtcttgcaatgactggctttcttctgattttcaaggttgagtgactggcagtctgcctgggcacacgtcaaagagcaccaccacatcaactgcatggctgcagtccctgtgcaggcagcttcctttgctccccagcaagtgcaggggctggcagaggctgcttcagccttgtattgtagggggaaataggtgccacatgctgttatgaccatggtgatggtgggggcgactggtgcttctacataccctggttctaagctccttttctggatctttgtagttacacatgggagtcaacagcccactgccttccctttatcctctatctaccccattgccttcttccagcttccccccaacccccacccccgtctaatgaaaaagaagttaaattcctatcttagcatcaaatccagctgtagttttttctcccaactaagcacatgcagtacggtacctcctcctgtaccatatacctcctccagtaagatactcctgatctctttctcctcctctaggctcactttaaggtccttgttgtatgtgaccctatgtataccctgaatgtggttcttattgaactgtactataactgttaacttgctttcaattagaatgcgaactcttcaaaggaaattcttactcaccagttgtctctccatcatctagcatagtgcttggcatacagtaagtagatgtaaatgattatcgaactgaattgatcagaccctaccactcccattgatttaaaattatacatatgcaaagaagggtcattttgagaccacagtgcaatcaagatgaacatgtctctaacttctgacttctctctttctgaatccgtctaccctagctcacccatctgtctctgcaagaagggccaagaagagcacagactcagtcaaacaaagatggaacaaaattggtcacaacttgaactattccttctttattttccatttctgttttgaccctttaaaaggaatttcaaaattttactttcttctggtgctactaacgtaaaatgcctaataatctctacatggatacacgatttgaataattatacacttgatggggttataaggaaagtttggaaatcatcttacaccttctagacatattccaagtcaaattgattaaagaaattagttctttctccttagttctaaatcatatgccaggaattccaggtttgtggatttgtcatttaattgcatattattgataaatagtattaaagacctttcctgaggactcactgttctgagtggtttctatagctctgtgacagatgttaccagttggccagtaaaatccattccaatttcctctctcttgcttgttttctcctgcagagcctggaaaaagctaagacacactttcccagtctcctgcaagttggacggtggctgtgtgacatggtctggccaatgaggtgtaaacctgagtctgctggaaagatactggaagaacttttgatatcctgataaaaggaacacacatctctatcattgctccctttccccttcctccatctgggaatgcagatgtgatgacagaagctgccatagccactctgcagtcatgaggcaaaaaacacaaaagcatgaggacaaagtgccatcatgctaaggagagcacagcaaaaagacagaaaggctctggtcctaaatggcacagctaacaagtgcccatttccatgcctcttgccaaccaacacaattcatgtccttatgatttcaatccctggtggtcaggttttggtcacttgaagctaaaagcattcctaactgattcaaaccccaaataaaaacattgccctaatgatgaaacagaaattggttactttggcctcaattaaaaaatgaaatgtagctaatctttaacaaattcaatcctaaatagttctctttatgcctactgtcaggcaggcccttcttctgtggctggatctgatttcctaaagccttaatttctaactcaacatagcaaagaggtggagggaagccatcgtgcccaaaccctcatgggggtcatgacttacagttgactgaggatggcctccatttatcacatagtctattgcaacttgaggttcctttaacaaatactaggttataacatttaaagctgatatcacagcttctgttacaagaatattattgtactagtttcctaaggttgttgtataaattaccataaactgggtggcttgaaacagaaatttattctcttatagttctgggggccagaattctgaaatcagtgtgtcagcagggcattctccctctgaaggctcaaggggagaatccttccttgcttctttgagcttctggtggctccaggtgttccttggcttgtggcagcatcacgccaatcttcgtcttgtctttacatggccttctctgcttcctcttctcttttgtctgtcttcttttcttataaaaacacttgtttgacttagggcctatcctgttaatccaagatgatctgatcttggatcctaaatgaattagatttataaacactccttttccaaataaggtcacattcacaggttctacgtggacatatcttttggaatgccaccattcaatctactacaactctagaaaatttattccactttccttatttatttttgttgggtctcatgaactttgatttttttaagctgtgtgaggaaacatttatggcaatttaagttttgtgttgcatcagaatttaaggttgtttcaggaaacacgtgttttatttcacattttaaagtaaagaattatttctctgattacattttagtctttatttctcatgttaaagtaaaaaataggtgacttcagatcagtaagtatatcatggtagtgatattaaagagtatttactaggcttagtataactcaggcaaaacatttcttgcaaattattcaccataatctttgacataggctggattattagttttaaggcatgaattactttctacccaggtcaatggtttttaaccctgttacacattatagtcacctggtgaacctttaaaaatgcatgcccaggacccatttcaaccaatgaatgcaaatatgtggggatgagcttgtgcataaaagtctcctaagttattcttatgtatagtgaggattaaaaactgaccttgactcttattagcagttgccttattcaacaccatttatttattcaatcaagtaatcattatgcacttttaagtgtgtaagtagttgcagtacatataaggacatataagaaatgcaggtttataatttagtagtcatggtgtataatattttgtgtaatgtgccatttatactccagggtggtagagccaaatgcttatagagaccttctctgctggtcactcttaaaaattcaaatcaatttatagaagtaacttgtatcacaaaaaattagccaggcatggtgaagcatgcctgtaatcccagctactcaggaggctgaggcaggagaatcacttgaacccaggaggcagaggttgcagtgagccaagatcgcaccactgcactccagcctgggtgacagagtgagactccatctcaaaaaaaaaaaaagtaacttgtatcattattgctttaactcctctgcactcaggtgcgtgtgtgaacacacacacacattgctggtaataatcagagcaaaataagactcctatggttgactatcttcagattacaccctttacaaggtcaggagccttttaattattttagatcccccttccgcagagtagaaaccaatatatgcttgtaaaaactcacgactggtagtgatccctattagtagaaaaagcttgagcagtaaagttgcctgtgccctggagaagtgctgaggactagaaattcctctagcttccagctatttgggaagacccttgggtgttgagccaacattggcaggtgcgaaagggaatgacactggggctgaggagaggatctggcagccaattagcagcgcttgttagagctcaccccagactgctgtgtgactgctcattcagacattcatagacacccctgtcacaaataagccacccagagctctgtagtcgtacaaagcagcaataggagtggagaagaaccatgtttgtcaggaaggccctgcatgcaagagagcggcagggcagagagcagagtagagcttggaggctatagttgtaataagctttcaggaaaagagaactgagcaccttaattattttatttttttttttgacatggtcttggtctgtcacccaggctggagtgcaatggcacaatcactgctcatttgcagcctgatctcctgggcttaagcaatccttccacctcagcctcctgagtagctgggaccataggcgtgtgcaaccatgctcagctagtttttgcattttttgtagagacggggtttcgccatgttgcccaggctggtctcaaactcatggactcaagcaatccacctgccttggcctcccaaagtgctgggattacaggcatgagccactgcacctgacaagcaatttaatccgaggagtcatggagtcttatacatgtgaagtcttgttgatgaaagataggaagatggagaggagctggaggagaacatgatattaagccaagtatttaaaaactactgatgagctaggaatcaagctgagtgcattcattcatatgttaatcaaatactttttgaacatcttctatgtgtttcaggtgttgacagtgcagaggtgagcacgtgttctccagggtgaaggacactggaggagatttagggttataaaaacaaacagataacaaatgcacatatattcagagtaacatgatagaaatagatggtcaggagataccacctcagtttgggcgatgaggaaggccttgacccaaggaggtgacatgatgtgagctgagatgatgtggaaggtgttggggcttagaaaacaacaccccaaaatgaaggcctcagaagcagcctcagaagcaaaagtttttctctgaccttctcctgccctcctgtttctcagtcccattctctcctgaggctagctatagaaactaggatccctcttccccagggtgggtcatagaaaccagaccccttcttccccaaagccagccataaaatctaaaaatattactctaactttccctccacctttctatgtgaaaactggccacagagaaattatctgacttaccttgtttgactgtaggtcgtaatacccccattccagagagggtcttgcccaacacagagaaggaaggaatgcatgctcaggggggccaagaagaatctagacagacaggccttcctggctttcttcactcagtctattagcattagatcagaccctttttttggtccaataatatttcggcacagctgtccatactttgttgaaacgaagtgtaaaaatggacaatctccccagtatttttgggtcttcatcctgaaggctcccatgtttacatgctaaataaatttgtatgccttttctcttagtaatctgcttgaatgtgaattgatttttcagcaaacctttagagggccaagggcaactttcttcttggccccaacaaaggagaaggacggagatgcatgtaaagcggtccaggcagagggaagagcaactgtaatggccctgaggcaggaatatacttggagtttgcaaagaatcagatgatatccaggctagaatcagagtaagggcatgtctggaaaaagtggaaaaggcagcaggggttaatgataagcacgtggccatggctgggcttcgggaagggtgaggcttcaggtctttgtggtttggtctgaaagcgactgaggttccactgggtgagctgctcagggcacatcctgatgcagacagcctgttggctctgacagcagctctcccatcctcccagctgcaatgactgccgagttggctttgctttgagtattccaatcacacagggcctgcacctctctgcattccctgggggtgattttgatagtttctctgtgtgcacagtgattttgaggcaggagatacatgagcgactgcagcagcataagaagtcagtggtgtcaatgcctgacaactaccatgactgaaaaagttagattcctgaagtgacttcatttatattgccatatcctgacagaatctgaggccactcttggtatatgaacacagtatcatcttatatatatggaaataaaaaagaatgggaggtttttttttttcttaagcaaaaggaaaatattaactcaagacccaaactgttttattcatttgtggactcccacaataccttccttacacagttatttcactgattctagaacacacacttttcctcatttaccatctgtgaaatgataatgcatcttacaatccacagtgcctcacaattgccatcacatggttgtcatagcccatacccacatgcttggtcatagctgttcatgtgttgagtataattggcatttaaactgtgttcaaaatgattacattataatttggcatcagtacttggaaagatacaaatacagtagggagaggataatttgatatttgtgaagcaaataacttcactggagaagagactgcaatgacatatttcctttaaaagcagtaaccatgtgcattgtgggtctgaaggaaggaagatatccacaaatgcatgaggccttattatgctttgttactgcaatatatgaaaaagattacatgttacatgccaaggaactcaacaaaggcaggagtaattgacaaagccctctatatgaaggaaatgttcaatctgtgtgaggctgtgatgggtttatgtgttggacagaatcaccataaggctctgtgtcacagattaattggcagcacttgtttttcttttgtaggaatgcataacataatgatgcatcttataatagatggtatttctaggttccatgaaatagagtggaacaaagtagatgtttttgtcgttagactagggctatgcaaatactagacctcacttatcccatcacgttcaaaatgtctctgcagtttatttacatattaccaaagagctgtccacttgaaaacttatagtcagcattgtgtctcaagccaaggtaaaccaaactaaacattcttatggcaacatggccaggcgctgtggctcacgtctgtaatcccagcactttgggaggccgtggtgggcagatcacgaggtcaggagttcgagaccagcctggccaaaatagtgaaaccccatcttgactaaaaatacagaaaactagctgggtgtggtggcgggtccctgtaatcctagctactcgggaggctgaggcttgaacctgggaggcagaggttgcagtgagccgagatagcgctgctgcacaccagctggggcgacagagctctgtctcaaaaaaaaaaaaaattcttacagaaacttgatactcttggttggtgaactgaattttatcaaaagcatctatggcacacaggcagatgattgtagaatacatggccttaatgaaaaataagctaactgcttaggcgattatttcaaattcagtttaaggaagtcactgtgttttagcgtctgattttgaacatcaggactaaagaccctgaggcttttttcctttaaggtactatcaggtcagtgtgaaaaagctgtttgccaggggagccagttggaaatgaatgaaataatttacattcctgctgtgggcaagttgtcaatcattatgtgtgaagcctgtaccatcatttttctcctatatctacacaaggatgctgtcttaaggatgtagtcaagtgccgtgacaaatagcaggtcaatagctgaggacacgttgcctggtgtgtggtggtagagaaagggcacacctctattccccaaactccaggccggctgcttgatgtaatagcaggttgtaaagtgaaaaagcttctgcatgaaaggatagcctttacatggggtacagagcgcagaaacgttttttggccacacattggtttttctcagccatggatcataatgattatcagtagaatcatttgttttaaatgcagagaagagctgaaatgcttctatgtatcattgcttctggagatttctagaaatgtgtgctaggtagttcaatttaccatgtccaaatggaactcttgatttctccctccaaattttccctaacaaatattcccaatctcaagaaacctcaggccaaaaacatttccaccgatccttaattcctttgatttatctacaatcaatatcacattcatcatctctattttccttgtaaatcctgactcagatattctcaccttcttcaccacaccactttagtacaaggcaccaccatctcttgccccgactactaggtgaatgcctcagtaggttttcaatgacctccatccccattcccacagcagccaaagtgagcctttcaagcataaaccaaaccatatctctctcctgtttaacacccctctgatgctcatgctcacatttagattactatgcaacccctctccacagctcacaatacctgatcctgggccaccactgtgacatcttttctatcagccttttccctggctcatgctactacagccacactggcttccttgctggtcctcaaacaggcacggtcctgccgcaggggatctgcacttgccgctccctcagcctggagtgctgatctctgcatggcttcttcccacacttggttcagatctctgcctaaatgaaacctccttaaagaagtctttcctgatcaccctcctgaagatctggtcactgtctatcctcttaccctgctctatgtttccttatagtatgtgccactagctgatatcatattacagacttatctgttacctgcttattgtctttgtccagctctagaatgtaagttccataagagcaggagctctgttggttttgtttccaatgcatttctagagactagaacagtgcttggcatatagtaggtgttcagtaaatattttcattcaatataaatactacatatacttcttcatatgtcgtcttcccagttggacactttctaggcatactgggccctcacaaagatatatagagtgtggactacctttcaactgaagcattttaccggacatgccaactgatggcagcacccagggatggcaatgagatggtgtgtgcatcacccaagtggccctccacagtcaagtaggtcgctgaagtctgtctctgatgactttgcctcccacgtcttcctctgtgtctttctttcccattcctcccctggcagcaattcattcagtgggtatttttaagcacctgctttgtaaagggcattgtgtgaacatacagctgagccctccgaagtcaggtcttcaaggagtttggtgtctggtggagaggcgcgatgaacccacacaaatacaagggctggtaaaaggtgaagtgtcttgccccagtggaataaggaactagaaactgaaattggctcatctgactctgagtccagcctctcatccactctgctgccttgcagcccacccaagcctgccttccctctggcgctcctctgcagtttgtttgtttgtttgtttgtttatttatttattattatactttaagttttagggtatatgtgcacaatgcgcaggttagttacatatgtatacatgtgccatgctggtgcgctgcacccactaactcgtcctctgcagttttaatctttgttctaaatcctccttttccccttctctatattcaaagcaccaaatcctgcccttctaggtgaagttatacatcagctgatgatcagatcagactagttcacagtaagtgagaatgactcatagatttagttctctcaggtggcgtttgtattgtagtttgtctctgctgcagccagtcacaaggagatacatgtgtgggagtatctgtttctctatttttggggggactgcgggaaaaaggatgccacctggggtctgcttatttactgtaagtctttctaccttaccctgcctcttgggcttccataatgaagtaggtctggccatgggtctttctccttccttagtacaatttctaaagggaaggcaatattccatttttggcatttgggaggtggtgaaacaggcaccctctctgttctctctcactctttctctctctctatgtgcgtgtgcgtgtgtgtgtgtgtgtgtgtgtatagtggtactacagggtcatttataccagcacgcctcataagttgcacccctgttcgtcttgtgcaccatgtgccctccagtggctgccacgaagaagaaatggaacttcctaagtcagccatcctgacagacactgttggaaactttctctgcaaggctgagaacatgagggaaagactgcggatgttcattctgttgttaaacgtatctctgttgcaagaccagcctagtgtaccgcctttcatgacacaatacatctgtgaatataaaataacaggaactggtggcttttctcatcaaaatccaaccagttctcttcagacacttcttaacctgtaaaatgggaatggcaacagtgtgcatctcatagggttcaggtgaggggaaatatatcaggatatatgatgtatatatgacatatatgtcagacttagaacactctcacacaaaagtgtctttaggtcaatcaacaggtatttatttgccacctccggtgtgctagaaactgttctaggagctggggatacaggagtcaacaaaataatctatgccctgatggggctgattgtggttaataatcatgatagcaaaggcatagccaggatccaaatccccgcagtctagctccgagtccccagtctcctccatgactccatagcacctcttgttcactgagcaagagaatgcgaataatacacttgagatgacgttgtgagttgagagcctggacctcagggataaagacctgtacttggcagccatctactttgagtctgctagctgaaacctgtccaagaacataacactggggaaaggaggtttgagaaaaaattcttgagcaagattgacaattaacgaaggggaagataaaggaagagttactaaaacaaattcccattattgttactactattattccctgtgctcatctagaggagtcaagtaacctaaggaatcaaattcaatgaaaaaatattggttgcacacccactctgagcgaagagtggatgtgcaacaaatatttgagcaaggcacgaaaatgatttttcattagacagatactttgcaatttaattttctaaaatagctgagtttgatggtcaatgagttcaataaacaattttccagctttttatatatctagcaattccatgatcacacagtgtgtttatcatctatcattctccaattactgaatattggttggggttcctgtcccccagttttccatacatttaggcctccttgcatggtaccctatccaggtcatttttttccccccggtgagcccccattgatcatcttagattttctgagatggttttgatttcacatattttgagtgggggcttacaaacaataataagatcatccataattctaaaatctctcttcttttctctaattaaaacctttgtgggccaggcacattgactcatgcctgtaatcccagcactttgggatgcctacataggaggatcacttgagcccaggagttcacaacaagcctaggtaacataaggaaacaccgtctctacaaataataaaaataaattagtcaggtgtggtggtgtgcgcctagtcccagctacttgggaggctgagaagggagcactgcctgagcctggaaggttgaggatgcagtgaaacttgattgcaccactgcactctagcctgggtgacaagtgagaccctgtctcgaaacaacaacaacaaaacaaaacaaaacaaaataaaacaaaaaaacccataaaacaccaaaataaaacaacccccccaaaatctctggggtgcactgattgcagtaatggtcccatttcttcacccttccctactctcaagctatttaccgtgtgattttgcagttgctcctattgagaggtgaactatatcctcccctcccaagctgattttgagttttccatatagcttcctttggccaagtgttggcagatgtgatgtaagtagaggtgtaaaaaagcgcttgctcatttttgtttgtttgtttctttctttgttatgaagacatgtctgcgatagcatactagagagtggggcacagggagtcccagctgtttcagctgagaccaccccaggtcagtcaactctcatatgccagaagactagagccaactgccagatgtgagggagccagatgagatcagaagaaatttgcagccaagcccagcctaaatcgctgacccacaaactgtaagctcagctaaacaaatgtctatcgctttaagccacttcattttcagacagcttgttccatagcattgttgaggcaatggataactgataatgcttcccataaatcttaggaacttggaagctgcccctccatttgccctcctttaagcaaaaaattgaatgctatttgcaaagcattgtataaaatgctttattagattatcttattgaatcctgacaacaatatctagcagacagatataatgctattatccaaatttcagaggcaaggaaattgaagcttagagaagtttaagtgacttgaccaaagtgcttttagaaaagcagagattctacaaccagtcttctaaatcttggaagactgcttttagccacggctgcctgccatttactctttggattctccattctacctgttctgctgcctacttctaccacctaattaggagaagaccttgtgttcccatttgggatatagatacccactttcatactgggtttacccctaatatttctctccataccactcatgtagatggttgtcttccgcattaatctggaaattttttgagggtaaagactaaaatacttatatttttatccccacaactctatgcagtatttttttaaaaaagatcatagtcatgttttaaggtagctattccataaaacatataaaaaggtaaaaaatactctcctagagaatatatgcatatttaaaaggacactgttattcaaattaatctaatttgtggaatacacagtagagggttttccccattttgttaaatagttttagttatatgttatttgaatgtagtgtttgcctgaatatctacaaaaataaaactctcttgactcatttatagattaattccagaagcagggattaatacaaaactggcagtgaataatttctgttttgcagttagtttctgcatttaagaaattgctttagggttcagtaacttgccctggacttcaggtatgctgccaccagatggcagcagggtgccaggcataaggcttgtaagcaaagaatttgtgtgctttctgaggctcaaggtaatagctctttccttaagttcaaaaagattttcagaccactgatttccaatttagcataatacatttctttacaaaaataggtaaactaaaactctaagccaccctaagacatctttagaacagatataaatcccaagctataaaatcacctaactcattattacttctcttctctagcatctaattatttctgtaatggcttatacaccatgatggcttatacgaatcttatacacctacctcagtgatagtgttaaccattataatttactttgaatctttatgatcaatctctgccatggcaccgtgtatgttagttttcaaaattctcaatagtttttctccaggtaaaaaaaatctatctggctttcctttcatctgtcttaagagagcagaggtttatcttttcagtattatctgagatcttctcttaagaccaaaagtatttctccactacagtggcatgaacagtgtttatttgcatttcgtgtatgtatttgtgaatatggagtacttttgcttttgtattttctatactatataataatctactagaatatttcccctctcaaagctcttggaagcacagaggcagtttaccatactttaacagaaatatagctggattaaaattttttttttttagcaacaggctctgccctaaatatctcaagaaaatactttaaagaacaaaaatcttcatgccaaattagcaagatacaggaaaaaaggtaagtgggcaaaatacagggaaaaaaagctaattcaccctgacagttgttacacaaagctgagagagtctttccctctcacatttacaaagtccaggagcggaaagactttcagcaggagtaagccatgagggtttggacaaggctggtaggggaaaatgttatctcctgggcatactgggaagctgagagtccagggcaggtgaatggggttggagatgggaatgagggaggacagcatctgagcagtaaatcctggaactagagttagcatatcaagcagggctatctatgcacccaaggtaagttctggctgggagaagcagatggcaactaagctgtgaaaataggctccaagggaccagctcccagcgtaactctgggggagggatctggggaagtacaaaaaacatagagaggcaaaagacaaataaaataggaggagaagagaaagggatggatcatagaaagctcttatttgattttgagtctcacaggaaacccatgaagccagcagggcaggtattttttatcctctatttacaaatgagaaactgagtcccagagggggtaagtgactttttttaaggtcaacataccgaggggcggatataagattcaaagtcaagtgacctgattccaagctaaagatgaaagaagagagggcacatttgaaaccctgacacacacactgtatgtcctactctttgctttataaacagtaagtaaaattttcaaataatggaagcttagtcttttaagggtcaaacggaagcagctttagccactgttgaaaagcatttctgaaatgtattatatttgcccttgcctcctttgaaaactgactgtaatctactctcttcttgatacatgggttataattacaaaaatttactatatttatgaacttctaattcagtagataccctcaggttctatggaggcacatgtgttttttaaaaaattaattttttttgctgccccacctaatacattcatggctagaaatagctgtgtagcagaactggctgagtcagctccttcttccctcacagccagctcttccttcttaagtgtgtctgctgctggtccctatctactgcttctgatcaggtcattccgcttattaaaatcctttagtgactccctctaaccactggttgcagtagtttgcaaaacaggctgcacatgaaaatcacttgaggagcttttaagacctcctgatacccaggtgccaacacgaaagatttcaattcaattgttttagatatggggccctcacctacagggattaacataagtagcatgaactcttgcttctggccaagatggaataacgggggctagatttatctttccaatggacacaactaaaagtccagatgaatatattaaacaatggttttcaaggcaacgggcatgaggcattgaaggacagtgatccctgagagatggaaaacaaacaaaatgagttgcatttgcctgcaattgcccctgagagaatttctaggccatgcagcagaaaggaagaattcagaaggagtctgcaagactccttaaatagaaaagatgaagcagagaatccaggtagactagcgtggctagagtttgccaggcagagtattagagagcagggagttctgatcagtacatgcatgtgaggaaatggtataaaatcaaatgaaaaaccagctgaaaagatgagtaggaatagtctttaaagttcaaactggactggtaaaactgagatttgaaaactattcaaattgggaagccctgaaattcaaagagcattggtcaagtactcagaagggtattgccctcgtggtggggaagtattgtcaatagactaaacaatactctgccttgcctaaccttaaaagcaagacctgaaagatcaaagactattcaaagaattttcctgtatcccagagcaatacccaaaaatatctgtaggaataaaaaaaaaatccagcatccaacaaggtaaaattcataatgtctggcgtgtaataaaaattaccagacatgcaaaaaaacagcaaggagaaaaatcaataaaacccaaacctaaactgacacaggtgttacaattagaagacaaagatattaaaccagtaactgtaactgtattccatatgttccacaagttggaggaaacagcatgtttaatagagacagaaaatataagaaagacccaagtctggccgggtgcggtggctcatgcctgtaatcccagcactttgggaggccgaggcaggcggatcacaaggtcaggagatggagaccatcctggctaacacgctgaaaccccgtctctactaaaaatacaaaaaattagctgagtaaggtggtgggcacctgtagtcccagctacttggaaggctgaggcagaagaatggtgtgaacccaggaggtggagcttgcagtgagcagagattgcagagattgtgccactgcactccagcctgggcaacagagcgagactctgtcttaaaaaaaaagaaaaaaaaaagaaaaagaaagacccaagtctaacttgtgaagatgaaaactataatgtccgagataaaaaatacactgcatagtaacagtgacagattagctattctaagaagaaaagatgagtgaacttaaagacatagcaatagaaacaatccaaatgtgtcacagagagaaaaaagactgaaaaaaaatgaataggacattggtgaactgtagtacaactttaaatgacctaatactgatgtatttggggtttccaaatgagaggagaaataaggtgagtaatagaaaatattctgaggccagatatggtggcttacaactgtaatcccagcactttgggaggccaaggcaggtggatcacttgaggtcaggagttcaagaccagcctggccaacatggtgaaaccctatctccactaaaaatacaaaaattagccagatgtggtgtcgcatgcctgcagtcccagctacttgagaggctgaggcaggagaatcgcttgaacctgggaggcggaggttgcagtgagctgagattgtgccactgcactccagcctggatgagagaataagactctgtctcagaaaaacaaaaaaatttaagagataatgactaaaaaatttccaaagttgatgacaatgataagtctcatatttaagaagctcaaaaaacttcgcacatagaaaacatgcaaaaaatgataccaatgtgtgtaataatcaaattgctgtaaaccagtgaaaaagacaacaccttcagtgcagccagggggaaaaaaactgacccattatgtatagaggaacaacaaaatggcggcaggtttcttgttagaaataaagcagaagagaggctggtggagcaatatctttaaagtactgttcgttagaattctatacccagcaaaactatgtttcatgaatgaaggcaaaatgaagtatttttcagacatacaaaagctgtgaaaatttatcactagcagcctcacactatagaataatgtcaaagacagtccttcaggtagaaggaaaatgacaccagatggaactaagggtctacataaaggaatgaagagcttggttggcttcaagggtgtgtgacctgtatggttacacaaggtcctgcagatagaagggccttgtgctagctttaatgttttgatgttactggctaaaaatttttaataatttttgaacaaggggccctatattttcattttgcactggtagctggtcctgatgaagaatacttagtagtccatagaggtggaggcagaggctggaatgccgagcttggctctgaagatccaggccatatgttcaggcatggaatagggaagagatggaggtggcttcttcagaggaaatttggaatgttttaattttaatcacgagaagggtgaatgaacagatgtccactaaaataaaaattttaaggtagcaatttctgggtaattagaacacaattttcctttctgcacagagatagatcataaatggctataattagagagtttcagttttttctgaagttcatttgttgcggagtgttcaaaactgtctcttcaggccaaaatgccttgtttattgtgtgtgtgttttactatttctgatatcaatgctttaataatgcctgttctgtaatattggcccagaggtactgcaagagtgtaaattcactttacatgaaaaagaaaagctatattacttccaatgacattttagtgattaaatgcattttatttgtagtataattctatcccagtttaggtcaaagctccgaagttgagagtagtataataagtgtggacatgcaaaagatgctgaaaggtagtagaaataataatgtcagatctagcccatcaccaccctccagaacatatatgaaaggattagaaatcaatgttaagtgtgtatttatttgggagactgtccatcctaaatgaggacaaatgtcagggtgcttttcccaaaacttgggctggctgagggaagcttcaagagaatccctggaacagcttgaaatctggatgcagggggtggagttggtagagtccagaagctttacctgatatatgcctggaaaagtctaaagctcagaggtggtatctagctgtcctgaaggcttgtggggagccagctgtactgtatataggtataaatgcaatgcttaaatccacagataatttataaagttcactctacacttgaatactcacatccagtcatttagttgaagccttcggctttgattaaagttgttaatatttgaagtgctgactgatgtaacctccctggtatggaaatatgaatatttctcatttattatgtcccgtggtgaaagcataaccttttacttaaaataattggtttgaaaatggaattagaatattcatcctccccattcctcccctgcaatttgtgaatttagtaattattcttcttggttatgagcataagttaccatttacctttattcaatatgtacacacgcacacacacacacacacccacacactctcacagaatgcaaaaaaaaaattaggaaataaagttatcgcaactttagcaatgagagcggggtagacagaagtgtgagtttataatgctgatcatgaaataaaaacttcaaagcaagcctaaatctgatactcataggatgatagctctactgcatttaaagcaaataaagttacatttctcaagaattaatgcaaaattagaaagtttcctttgaaaatctcttagcacatctccaagtggttagctttcctgggaaagctggaaattaaatcaacaacattgaaagaaaaaaaacctcacagtcctaaattaaacagtcatgtaaatatagtttccaaagctattaggcaagaagcaaatgattttctaatcaatttactgttgcaaaaataatgccagattattttcatggggcatgtgaaataatttacatgggacacacgtggatattgctaccttagcaatcttatctagttctacccaaaggtatttaaaaaacaaccactgacgctgaagttatttgtaatcatatcagcagcctatctcctcatcctccattctcttcccctccaccagctgacttttgtatcaaaggcaggctacccttgcacttctcttttcacttaacatagaacaacagttactggagcaatctggttcccttaaaactagcgactcattacaatggttcaggatgtgaacttccctaaaaggctttgctctaaatcaaggtgactgtacattcccttttaggctagaaaacaacaaactatgcattcttagtataggattattcagcccatatattatatgagactacctcatatttgggtacctctctcattagttgggataaacaagtcttgaatttgagataattcaaaatctttgtaagccaaaggcatgcacacattttgcctttttctcattttaaaacccagtaacccaaaaccatcacatgaactacccaattctattgggcatacaaattttgttttctgatttccaagtctgaaggttcaggtcaatatttgtccgtaattaacatggacataattaatctgctgagttaaatgacatacaaatcctcaccaccaagagtgtgaacttgcccataaagttgtcacacagaaaattgaattcaatcagcttactttaaggaaaatatactgagttagtggtagacacagatggcatgcttcagaggattttggccttaaggtctaagagacagtgactatgttttcaaattttgacacaatgcttgtgacaggcacttctccctgtattgaagccagaaaactgttaagagccaacatgggtggaaaagaccagttttctttttttctttttctttttttttttttttttttgagacagagtcttgctcagtcacccaggctggagtgcagtggcgcgatctctgctcactgcaagctctgcctcctgggttcatgccattctcctgcctcagcctcccgagtagctgggactacaggtgcccgccaccacgcccggctaatttttttttttttgtatttttcatagaggcagggtttcaccatgttagccaggatggtctgatctcctgatgttgtgatccgcccgcctcgacctcccaaagtgctgggattaccggcgtgaaccaccacgcctgactagaaaagactaattttctgtctcaagtcaaggctgattggcctcatgggtggtggtggatcagtccctaagccccggcagtaaagccaggggccgtgatccccatagtcactgcagctgtctacaaggtctggctgcagtcactaaacaaggatctctaggccacaggtacccccggcactggggaaagtgagtgcccaagcttacatcttaaacactagttcaggcctttggattttgagagacatagagcctcacattgtaagtgatccttacttcagtgaaaacatataatagagtcctattgaaatccattctttacaatgggagattactgctaatgctagctaggtgagtgattcatgtgctacctattgtaagtattaattcttcattaggtagcagtgtgattcagaaaatgttacatagggatatttttcaagctattccattaactaattaactgggatgcaacttaagttggaagattgtttggttgatgtatggaaggtacccctttaaaaaatatctatgagtagccatgtgatgagtgtcaagttcttgacagagaattgaaatcttagcctgctgcgaccaaaaagcaatactgtttcagttagttccgttgccacacagactgaatgaaattaaccaaaggctttatgttagacaatgagtctcttctgaaataatgatagcttttgtgagggcataagaagcagaaagttaagaaagagttacttatggccatacaatcacattaatttgtctatttaatgtgacttttagattcaagaacaatttctatacgatgttctagaaaagacattattttttcagaaagacttttaaaagcaaggaattaattagttactaataataaccatcatttaaaataagcaatggcatgtaatgtgtagaaccgggacttttggcgagaaagtgacataaagagtagaacagagcacttttgaaccagcagaaacttatttgctttatctcttagttcataaatgccattttcctcaatcatttactataaaactaaaactattctttaaaaacctaagtgatttctcattgttactgttaaaaagaaatgtgtgctatgccaaatacaattcaaatgaatgaccattttatgttacattttcatcttattccttcatttatgctagaaaataacaaaagtaaaaatgcaatgagaaaagtatcaaagtcatgtatgcagattcagttgatctctttgggcttgactatttggcaacatatgttggccagtttttataggaaatctatgctaagtgtatgaataaaacagagacaacgtaagattagacactagcttcagaaaataaaattttgataatacagcagcctatttagtaagaataaaagcagtctcttggagtgtgggatttgtatatgtgattaagaaatagagacaaggggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaagaaatagagacaaggaaacatgatagagatagaaaactaaaaaaatgataatttaaatctttaacagtgaatatgagcaaagatcagaataggaacctatttattatcatatctatatcctataactgaaaaaatttcctaaaaaggagaacacaaaaatgcttggaagattttcttggataatgcaaaataccctgggagttctctctttacctcttagttcccccacatttaaacttcaaaagacaatgactctggagcttgagagagatcgatatttaaaacagaaggcatatctataaatccccattggatgtccaaacacttataaaaaaagaaaattaaatttcatttatcaagggttgaatagttaaggtgtcactaagagaccaacttacattaataagttcaacctcccagatttttttcaacaggtccatcgaagtgtagccattaattagaaaggctttggtgtagtcgcccagttcaatggaatccagccactcagctacagaggtgggatggtagccatcatgcccaatgggtctcatctgtaataaagaaaattacattaggattaaactgtatactttgtgtcccaacaacagaatgcagatttccccttgaaaatttatttgacatgaagaacagatctttctggagacggaaacaaggaaaaagaaaacactttctgatgtgttttcacaattctaaaacattaataattttcacgctgaataggttttcaaaatatacacagaaatttccaatttagctgctagattaactctatatttggaagagctaaacatgtcaaacttctgtcatagacattattggcattctggtgggtggaattaaaaatgatgtcagttgaatggcattaaattcgatgcgaaagtcaccaggaagtgcactttcaacatgtagatgataattctcatatgcacagcaccaaagcatgtgaaaatactgcatgacttaagcattcaaagggaatttgtgcttatgcaagacatgtattggaggtagtgcaaacacgctggagaaacatactgctgcggtgaaccagtaaaggagaggcctttgggtattttaagaccatgtgttctgcatcgactctacagtatgttagacatgaatagagaacttgctggcagacaggcatctattttttgtcagctatatacagatttttaaaaaataggagaacaaagaaatgtgacagcaacataatgtttctgagtttaaattggagtgtgaaagtaatttaagcaagaggaacttctgggtttaaaattttgtatggattattctggtcctttagcttttatttgaaattgtagctgaatctgtggttcttggttttcgaagtgactcacttctaaaacttgggctgctttgcatgccacgccgtatatctaatacttcagtttttcaggagagctggcacctcatcaacctgatgggggccttcggtaaaattcacgatggaaacagcaaggctgggcaaaacacaacatagattttcctctttctttgattcaaagagataaatattaatggaaatttatatgattctgatttgcgagcagagaaaagattagtctgggaatcagggattcagattttaatcttaaacatggtaagctttctatcactatgcatggttctcatttttgagattctccctactccttcattttaaagttactttttctcttttccagttgttccgctccccattctagtttccatttcaaagtttaaatgttctctgttttattttattttttttgaaatggagtcttgctctattgcccaggctggagtgcagtggtgtgatctcagctcactgcaacctccacctcctgggttcaagcaattctcattcctcagcctcccgagtagctggaactacaggtgagtgtcaccaagcctggctaatttttgtatgtgtctctactaagagacagagtttcaccatgttggccaggctggtctcaaactcctgacctcaagtgattcacctgccttggcttcctcccaaagtgctgggattacaggcatgagccactgctcctggcctaaatgttctctattttaaagttagagtacaatttattatttacattagagtctgaacttggtcagacttttgtacttcacttttacattgactgacccattttagctactcattaaatatttgttcatgtaacacttaactctgtgtttattatgtggtagctacaaatgtaaatgacaactcagcatttgcagaatgaaagtcagtggcattcacaaatccctggatgttatgtatgtataagatcagaggctaggacccaaaagggaggctcatagatattcggtagcttcatattctatagagaattacaaaaatattggggctgggtacattctccaggcctcgttaaaaggtggttgaactaactctgttaacctaaataatcactctggccccaggaatcttcctgactgccccagtgacatgaaataagaaagaaagggaagaaagtgagaaacactaaggttgaagttaactgcttagtagggaggtcttgccgttggcccatccataaagctgaccactccagcagcagatactcgggaaaagcttagggagtcttgatgactggatttgggtcaaagtcagttgtctcataccagtgaactgtgcaatggggttaccacaggttacccccaagcacttacacaacactcttttgaggaagcaattagtggccatctgacacacagagggtgttgatggtcggtggtggccaaagaatcagggaacccatgacaggactgcaaagaaaatctaggtaagtacaaagatgtttgcttgtccctccaatccccctttcttgtcccaatgccagaaaatttagaatcagaagagagaagtgccagtcccttaggggaagtctaaacttgggggggggggaggtggtgaggaaaataaaactggaggtttcaaataaattggaactgagccttcaacattttacatggttggaaagttattggaaatgtctgagatgatatttataaatagtaaagggagggtcagttgagcttggttgaatgattggaaaataaaaaaataaaataaaacagcaaccatcatatcaggattgcacggaatgcaggctgttcagtggtctgattactcctgtaaggcaagttctcctagaccaatcttaaagaggtgagagggagggaaatatttggtgggaggatgaaagacaagggcagggtagagagcacaactgaagagaccttggaaatgggtatgctgaggtgtacagggcagtatcatccgcccactcattcaataaatatttaatcaatgcctattctgatgaatgttgtggaaatggtagagaacaaaacagtcatagtctctccctcatggagattataactcttaattaaaatatgcaaacagatgaccaataaattatgaaggttctgcatacctgaagagaggaaaccattagagccaaatgcagttacaaaattaacttgacacatatttaatgatatgcagaatagttactgtgctgcacaataatttcttccaaagcaatgatcccatctgttcctttatttctgtccctactgccattaccctgtttaggttcttgttagtgcttacaaaaactaacacaatagccttctacatggtctcccacctttgatccagcttgtatcttgctactacattagtcttcctaaaagtcagacccttaagtgtacctttgtataaaagcctgtagtggctccttctcgaaaaaagtccaaatgtcctattccagcattcaaggccgattgagattagcctaatctcccactcctctgctattgtgtacccaataaatgtaactagacacgtgtatgtctaaacagtacattaaatcgctaggcattccctgaaaatgacctgtatatgacacagtcaatatctttgctaatataacttcccatgcttggaatgcttttgcccctgcttctggagtgatttcttcaggactggcttctcttcttgagctctgagatgcaaatttctaaccatttgtaggacatctcacataaatgtcctataggtgtcaccaacataagtcaaaaacaaatttaactcctttagttcaaaaacaggctctcttcctctttttttccatttcagttaagggcaactattactccactgcccaagcagaagcttgggagttatcttactttcctctttctgtttactatcatatctaattaggccaacatggtctatcaatttgatttctaagatgactctcaattcatttctcttcttccaaaatggactttggaatatgacattcccagcagtgctacgtatttgttgggtgatctttggcaagttactctttcagcctgtttcctcttttttagaataagcataataatacctattccaagtgttgttgtaaagattatatgaaatagggaataaaaattgcctagcacagtgatttgaatataatagctattcaattataactcttagttctcttttctccccattgccctaaattagacccatgcttattttgaaattgcataatattctgccattggctgctagtcttttcagcttccaatcaaagctctcctctctcatcccttcctatttcctctatttccttccttctttatcttgttttagaaatggtttgcatctgctaacatctttacccctctccccttcagccgacagttattttttagaaacatatctaacgaggtcactcaagtcgattgaactgtttattccaattcttcgttctcttactgtattagaattatgcccctgtgccctttgccaagggatcaacattatgtctcagtgtggctggagttacttcccagtctcatcaatgctggccaatagaatgcgtgaagtgtcagtgtggtggttagagacgaggtctctgtgctcctgtgttctactaatctttcagtgttcatatgctctctcataagaatagcaagtgctgagaagttgcataactcctggttctaggagaaagatgaagactcgtggagcaaacctaaatttaacccaaagcttggaatctaccctagctcgatggggctcaggaaagtccagatgaagttagctgaagcacagcagacccgtgagtaagaaaaaaatattttttgttgttgttgctgtgaactactgaaattttgattacagggaaaaactgaatagtcactccttgtttaaaaacccttggtgtttatccattatgcctgtggaatataaatcagaccttttagtttatgaatctattggcaaatgcatcttcatgagactgagaaagattagggatgctgaataagcaaacatcagtatccttcccaagctacctcactgtcatgcagaaactctgcatgccacatcttttttttttttttttttttttaagacagagtctcactctgtcacccgggcacccaggctggaatgcagtggtgcaatcttggctcactgcagcctccgcctcctaggttcaagcaatcctcccacctcggcttccctagtagctgggaccacaggtgtgcaccactacacccggctaattttcttttgtatttttagttgagaccagggtttcaccgtgttgcccaggctggtctcaaactcctgagctcaagcgatctgcctgcctcaacctcccaaagtgttgggattacaggcacaagccactgcccctgccctatatgctgcctctttattaaccctaaactaagtaattctttattgtatgagtttgatttttggggcataatccactgtacatgtaatatacctccacatcttcgctcatgccattccctctgctaggaatacagtttctactttttctcctaatgaaattctatctatccttttttttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaattctatctatccttaaaaggtcctgtttaaacgttacctcctgtgtgaatctttctctaatgttaccattattccaccgaaaaatcatatcttctgctatatttctgtagtattttccatagagttctattatagtattattaaagtctgctttcaataatagagaagtgagtatctgtcttcttcattggactgcctaccccttggtgaagaaatgaggtgttaatcatttttgaagtccctaaatcgtccagcagagcatctcacatatggcaagcatatgctaaatgtttgttaaattaagtgacttaatgaatacatgaagacaaaatgacaaattcatttcagtggcttggtatccatttgtgggagagatttgtattttgtactccatgttatgaaaactaaggttatctttttctgcctaacaataacattcataactatttaaaacctccatatatcaagaaccagttccagataggatattgtgttacagaatgcaatggactttgtttccatagcacagaagacttgattctattagccatgtagccatgggcaagtcacttcatctctctaagcttcagtggtgtcagctataaaatgaaggtattggaccaaggatctcaaagctgctttgtaattcctaaattttgcaattccatgactcgtaaattaattttaaattagtaacctatttgtttacccaggaaagaaaaaataagcccaaagacaaaactaaaattcatatatatatatatatatgataggacgtgtagactaaaggtcagatggcattcacatttctttcatgtatcttcagcagtacccacagggagcactgtgactgcattctcaaattagcaatgatgaaactttttttccagcgggaacatctggcaagacagggctaggaagtgacagctccatcggcctgccaggccagcagtgctgctaagcatgaacggaagtcaggctcactctataatctgagaggcagagtggtgagcaggcagcaggcattcattacagaggctcgcaacaaggcaatttgattcaattagttgaattccaaagtctggaaaaacctaagctgagacagaaattcgagatagcagtgaagctttagtcttgggaaaattgagatatattaacatattttttttttgccaaatgccttccttgttcttgttccacccaaatgactttcctccaggagttttttagagcatacttggcctcagagagagtatgctgttaacatcacaggtggtacagcaggcagagaaaccacaggacagtactctgtggagttctgggtttgagggggtcagctacggggcagctgaacaacccatgctctgagactgcttgatcgacttcaaccagagtaactcttattttatgcgttttatacaagtaagaggaagaaaggttttctcggctttaaaaagaaatgtttgaaaaccacgaatctagaagacttttgtaagattacatgaccactatgattttattttctcttaactttttagctttatttgaaatattatggatctgttatatatatgtggttatatatatatatacacacatatacatatatacacatcacacacacacacacacacacacacacacacacacacacacacacacatatatatagagagagagagcctgtcattccatcattctttctctttgcctgaagccagcattttctgtgcagataaggataatatcttatgagatgacggagccacaggatggaaggtatagcaggaggaaggcaataaaaacaggtaaaaaaaataaaaagagagagaaaggtgatatacattataatagctttgggattaaatgagaaaagtagttcttgatgggacaacttattaacctagaattatgatattggcatggtatttagaacaagaggataaggaaccctgaaaagccaataatggattagacaggcatttttatgtccaaaagtgttagaaaattgagaaaaagactacttgttgttcccttaaacttgtcctctcttcttccacataatggggttaaattgggttcatgcctgccggactagagacaagatacatcagctttttttctggttgctgctgtgaaaatatggttgagcctgtggaatgctaatgaaagtgttgcatgtaactttcaggtcacctctagctaaaagaagttcctcgacctagaattcctcttttttcttcatcttcctataagctggaacatcagtgactgcagttcagctttgactacacaggcaaaacaataccctggagtctgggaaatgcttctcagacctcaacgtgcttaggaatcatgcagagaatcttattagcagacgattctaattccgttatttggagggaggattggagattctgcatttctaaccagcttcctggtgatgctaatgctgtcagcccatgaaccacactttgagtagtagtgctttggaggatgacagaacaacaaatagaaggtcctcggtccttccacaattgcatagagcaaagccaccttgtaaacctgcactgctcatttcaagactattatatgagagaaattaatattcgattctttaaaccactatattatgaatgtctctatttcagtatcatagcctttccttgaatacaaacataactaaaaataaggcagtttcatgtagaacatttaaatgaagcctgtacttccatttgacattacattgtattatctcttgttttgtggggccgtaagttttcacatctgttatcgttaaagaagcttcatttcctttaactgtgtttgttggcatttctctgtcaatcacagcatcatccctttgtaacaactatgcaagggataagaggagaaaaatgcagggaaaccccaagtttctagcttggatatctgggcaaatggtggtgttaccaggtaaaagagaaaagaaaatagactgggatgacatgaataattttgagacatgagaaatttaagatgctatgctgtggaatggcactttaaatttggagaagtctggggagacacgcggccttgggcatcatcaaagtacaggtaagagtgttggcaactccacttattagctatctgacctcgagcaaatcactcatacttcctaagcatccattttctgattagtaatgtgaaagattaaaagaatatctatcgctgagcgttgccatatgtattcaatgaaactacacaaggagaatttagcacaatacttggcacacagaagcactcaataaatctttgttattttttttctgacagctgaaatcatgcacaggtaggactgcagaggtgactttgtagtgtgagaagagaagtggcctgagaatgaaccaacactttcaatgcataaggaacagataaaaataatactcaggagaccaaagaaggaatggtcaggacaagaaaagaaatgggggaaataagagtgtcaaggagagtgtggtcagcagtgaggggatgctgcagagacgtctaataaaatgatgaaggagaagggtttgtgggatcacaaataggtcatcggaaataggtcaccagacaccttattgagaagagcacagaagctgagctgccctaggttggggagtttgtatgggaagaaaagggggagatgagattttagaaagcacagaggaaaacacatggaaaggggtaaagaaatgaggactcagggttgagaagggtcagagtcataaaacagttaagttccagggtgcagtggagattgcaggggagggcttgccttttgctttgacactttgccctcctttcttgaaattacggatctgacaaggatggttggagctaacttcagggtgaatactctgtgttaaaacagtgcgagtgtttggaagctacatggtttagacttggtgagagctggatgcttgtacgtgaagtacctgtgaccttctggtgaaggtcctcacgtgggcaagagctgtcgcctgtgttgtcttcactcctcagatacaaacacagcaacctatcatttacatagacccaccagtgccgatatccctgatgtgccaggctcagctacttaaacttgcctaggaagctgccgtggaccgtggcttctcttttcccacctggatgtactttgtacactcagatttcctgcctgatatggcttttgtaatacagatagctgatatcgtcaggtacttccctctattctggctccttgttctagactcttctgctctgtcctgctgctacccaagtcttggactaacagcagtcctgaaaataaacgaggacaagcagtgctagcagacagtgtgctgccaagtccaaatgcaggtctatcaagtagtgtgaggatcaaatctacaggctgtgagacctgggcttagacatcactgtgctgtttcatcagtggctcttaaaaggctgattgaacataaaagagaaaggctgatcttctgaccacgaggccccagaaaaaagtctacctatcaccatctgagtgctatctacggcagtgcaactttgctgggagggacgtctccaaaatgctgagcactgttaatgataagaacatcacttaacaatgatgtgggactttaaagagcctcaagtgatttcacgcatgtcacctcagttgtaaagtgttttaggtgatctttaggaagacaccctttaaggagtctgagagcctgagtatcccatataattatattccttctgtgggaatggaaaggattaatatactgtgactgttgttggaaagcaaggagtgataaactctctgtgttgtgcatctgtagcaagggaggtatacatgtacaaatacgtctgctacttgcagctcctttgtttacaattagactctgttatggatacaatttctataaaagaataaagagaaacataaaccctcagaagtaagaaaactgtgtctgatgtcactacgaactcacagctacagaaagtggtaacccctctattatttttcccaccactgactgagccttactgatttggggttccttgagtgttcagatattgaagactcccagctgtaggcataaggcagaagcagtgaagaagtagtatctggatattacttgatactacatttttgggaaataaagggaaaggaaagtgctttggactagacactgtctctcaatgttctaggttttctatttcgtgaaaaagagaaatgaattaaggtctattccagagagggcctgaggtatccctaattttgaaaagtcttagatcatggagtaaaatagaagtgaagcaatggacagcaatgaaggactagatttaaaaatgttttcaagacacataggggatcagcttccaacagcacagaatagcctagaagcactagactggccctgtctctagtcatcagggataggggcacgccctctggacaaaggcactgggaagactacaagttaaaggagttaagttgccaatgcagccaagttctataaagcatccttgggaaaaaaggtcaaccgctacagcaacaactacaaaacaatctgtcttatttcaagccgtgtgtgagagctactagtcaggcactgctctttttagcttcatctgtgcccagggagattaactctatctgtagcagcacttgagaaatgctatctgccatgtaggatctgtgtgggatgcagatgaaaagaccagtagagccctaacacagtagacatataacatggtccttggggttgaattattttattgaatggttttgttgtacctctccctgaagctttgcgtaaaagaggtgtttttaaaaatttaataagaggaaatgtttttaccatcttttcatttctaaaattcttgttgaggtaatgttgaccctagagccttttgttaaacatcgttatttgttttgatatgtttccttgttgcaaagctttttttatgaagcaagagttcagattaaagatgaacagaggatttactgcaactagaataaggcgctgaacaatgttcactagcattcacatttccaagctctactagtgatgtgaactatatttagaaaaaagacacggggtctctttttttctctgacagtacatgttttctgtcattcatgcagctatttggtggttatatagtacactgctttgctcttcaaacagaaactttaaatgctactattaatcaggaatatcatttgcatacttttagtctcaactaaaataatttccccaaacttgagtcttcagaagataatgaatgccctgaatgtcaattctatttatttgatatttaaaaaccatgtcctttctcagagcctccaggcacatgcataataacataatccacagaagtacttcaagcagataaatgtaccacacaaccagaattagcagtacacaaatgaatgacttatgttctacctgggtagagcagtacaaaatatgtcattcacatggtggtcaaacaggagtatactcacgttcacttagggagttacaaaaatgaggacctaccatccattccattcatccatccatccatccatccatccatccatccatccatccatccatcccatccatccatccatccatccatccatccatccatccatccatccaaccatccatccgtccacccacttatttactcaacaaatactaacagtatgtttgctatattctaagcactgttctggatgtgtcagtgaacaaaacatatgaaggtgccagtccttgtggggtttaccttctaagtggggaagacagataataattaataagcataataaataaagtatatagtctgttagaaggtgataagtgctgtgaaaaaagagaaagtgcagtggggggatcggaagtactggagtgtgtgtatggtgtggcaggtgcagtattaaatagcgtggttaggggaagtttcattcagaggagaagatttggacaaagatttaaagacagtggattggctgggcacagtgactcatgtctgtaatcccagaactttgggaggccgaggagggcagattgcctgagctcaggagttcgagactagcctgaacaacatggtgaaactctatcgctactaaaatacaaaaacccagccaggcatggtggtatgtgcctgtaatcccagctactcaggaggttaggttgaggcgcgagaattgcttgaacccaggaggcagaggatgcagtgtgttgagattgtgccactgcactccagcctgggtgacaaagcaaaactctgtctcaaaaaataaaaaagtaaaaaataaagacggtggattggctgtgttgagggtgaagatttcaagtagagagaacaactagagcaaaggccctcaggaaggagggtccagcatatgttcaagaaataacaaggagaccaatggggttggagcagtgtgtgtgcacagagaagagagggaaccaggggccagataagtgagggcttataagacctggcaaggattgcctttcaatctgagggaaatggggagtcagggtatgcatttgagcagagttgtgacatgatctggcttacatttcagcagaatcactttgactgctgtgttgagtaaagctaataggtcttttcagaggctgtggaagtaattcagaaggaaggggctagtggcttggataaggtactaaagtaaaggcagcaagaagtagttagattctgggtatcttgacggtagaccagcataatttcctgaaacacaaaataaaatcatccttgttctctaacatggatcaggaatctgtcagtttggtggttgcagctgtgtgtcatgggtctcagcttgaagaggactgtattcgttcatcgtgtgtgggaacatatgggtgactggcagggacaggcttgcagcagtctgtgctcagtgaggattccaggggcctggaaagactctgctcagagattcaaggaataatagatgagtatcagagagaatgggtgattctgaatgattttaaaatctggcactctgactgtgccctggccagtctcccatggaccatcccttaagatgaagaggtttcaattaaatagctgtatcatgaaacatttttggacattgagaacaaaaggagtaggcagaattagcaccagcaactttgtcagcaagaagagatggtgccatattgcagatattggtgccctcaacattgggcaccagcagttggcaatgatggccactttggcaggcttcagtggcattggcagaacattcagttggcattggctaaggtgcccttgatgggaagacactgggtatcatagccagagacacagacatcagtacctttgacacattgggcacctgcagctctgaagcagcccttggcattcattagtggcagatttggcaccttcagtgagtatgaagaggactgagagcacttttggtaggtcctggtggcactgtctcaagctgtggtgacagaagacatcaccacaataggctagagcaagagaggcagaaaagggcagatgtctcatggtcagcggtagtctagttaacagtgcacatgtgacaggagacactttgaatgaatcattagaaggaatttcagtaaggcctagaatatgcagagaagtgttgctctatgattgttgctgttatcctattttgaagccctggttggagttcctgaaaaccccttttatatttatagttaagggataatctaagaactattccactaccattggagtgagaacagcagtcacaacaaaaaatagcttgatctttaggaaaatgtttccagcctcatagtctgttgtatgtgcgtgtgtgtgcatgtgtgtgtgtgtgtgtgtatgtgtgtgtatgtgtgtttgtcagtctagaatttctaattatctcagacaatggagtgactaagaatcttcagctctatttatgggaatccccagtagagtcactcttacaatagttttagtagttattatttatttaattcaataagaatttttaggcactatagtgcatcatatgtataacatcattctagatattgtatatctaggacaatatatatataacatcatcctagatattatataaatgcaaaagggaataaagttcctaccttccaggaatatgtaatttccttgggtatacatttgaaatacatgcaaataaagttctgtgtcacttaacaacagggatacatcagaatgtgtccttaggtgattttgtcattgtgcgaacatcagacagtgtacttacgcaaacctagatggtatcacctgctaaccatctaagctattgctcctagtctataaacttgtccagcatgttactgtactgaaaactgtaggcaacttaacataaattactaggtgatggaaatttttcagctctattataatcttatgggacctcttatatatgtggttcatcactgacccaaatgttgttatatggcacatgactgtatacaaagataagtgccagtttttataagttctagaaaaaaatgctagagtggattggaaacatttgggtgaatttcttttatagtttctcttggggttaatatatggtgaagtaagtgattgtatgtgtgcttgtgtgtacatgtttgtcagagagagggatgcaggtgggaggggtggggggcagagagagagagagagagagacagagagagagaaagggagggtgaatatggacatccatttctctttattgtccctagtcctagtcctagtcctagcaggcacaggcagcatcctctgtctgaagtgactccttcaatgtcctagttggctaaaaacacctgttcattctttgagattcagttcaagcaccatccacctgcccaaaaagctttccctgatccccatgcatttagctcttctctcctcttgtagcattttccacatagtattctagtttttgacatatctatctctgtctaaaatgcaggcagaactccttgaggcagggaccaagtcttctccatgtttccattcccatctctggacttagcatagagctgaaatgaatagacagtctgattgaatggatggacaatgagcaatttgctaatgaatgtctgtgcatggccgtgtgggtgtttgcagacgttatgcctctggagttgctctagcttcctttcatctacctctgagcctgctgggtctcgggacacaaggtaattgttactttatgtctacatcacgtggcactcagaaaagtgatctggctgaagtgcatgataatgtaattgagtcccagaggtgacaggcagggaaattgatctctctatatttactgaaataatctcttgtacatctgtggggaaaatttcacattcaaaactttcttatgatacatttacctcttagtatttagaaaattgtaaatacaatcctttgccaccaagcagtagcttccaagtaaagaaggggttgagggttaaaactaatataatgcattgaagaaaaagcttttaacctgtcaggactctgtgattcataaattataaccttagaaatcatttaaagtgtatccatttagcacttataccttcatgaattcatggaacaacaagtaaagctaaaatgtatttcctcttgaagacatgaaagaggaatcttgcagtttcttgggtactcgtttcctttgataagggcagtagttatctattaactgaatgtctatttactaaaatacaaagcaatagacttgtgtgaaatagtaaaaatggccagtcattttttccccaagatgagtaaattgatgggtgattccacagagtacagagacggggcactccagtaataggaagtagaggaaagcagttaagggcatagactctggagccagcctggccagtttcaatcctgactctgacacttactagtggtgtgacctcaggcaagttacttaacttctttgagctttaatttcttcacctgcaaaatagggatttaattttgagatttaaatgtgttaatttagagttaatctgaagtacttagaatagtgcctggcacgtaggcaattttctatttaagtgattgctattaacataggggtttggcccagaatgtctttctggcatgctgaggaacatcttggggaacgtgtattctttagatagagttcactatggatccacagaagaccaaccatcaggctagaacccaaagccaaaggataggtggaaggactactggtttgaagtagaaaatctcattgattaccgcccctcctcatcccccacaaaaataaccacaaagaaataccacgtaatgaaacagtgcttagcttagggaaggaagaatagtaactatgtcacttgtttagcctgcttcattaagctcactataggtatttgtttgggtttgaaatatttgactcattatagcttgaaggacaaagtgatgaatgaaatttatagctggattgatggcactagctgtatttcagctgtaataaccagaggatggttattacgaatgagaaaaaatagcatctctatctgcctgttagctaaacatatgctttggatcactttttgcttggagtgtcatgagttatcacaaacttccacaacaaagaagttttcttttttaactttgatctatgtattatttgtttttttagagacagggtctcattctgctgtccagactggagtgcagtggtgggatcatagctctctgctctctaactgctgagcttaagcaaagctcctgagtagctaggagtataggtgtgtaccaccatgcctggctaattttttaatttttttggagagacagggtctcactatgttgcccagccttgtcttgaagtccttccctcacgcgatcctcctgccttggcctcccaaagtgctaggattacaggcataagccaacacgcccagccacaacaggtaagttttaaaggtacataggaatggctttttgattcatctgtctccttctccaggaacctactcctgattccctgaacagaagagaccttcccttttacttaacgtacaaaacttgttatttttactcctattatagcttgtttcatgttctgacttgtactatattaagatcatttgcatattggtctgacttcctttgctagactaaaatcttcttgaaggcagatactgtgtaatttcatcttatttttctccttgcactgtgtcttgggacataagtaaatgctcaattcatttgcagacataacttgaacagaaatatctcacttgaatgccattgatggaaaataagaaatatagccaaattctattcaacaattaagttagcacttatttcaattgtatggtaaaggcaggtgacaatgccttattcaaaatggcgaatatgctgttttacagttttcgtgtaaatgcacacagttctgcttttctgtgaaatcacaatgcctttagcaactaaatggaactacactgtcaagatctgactgctcagcttctcagttcacttccattccattctatgctatgtatatttatattgagtccttgcttctaagagatgcagacaggaagatctctctgtattaggcttattcatttaatctctctcttttttttttttttgttttttgagatggagtctcactctgttgcccaggctggagtgcagtggcgggatcttggctcactgcaagctccacctcccgggttcaagtgattctcccgcctcaggcacccaagtagctgaaactaaggtgcgcgccaccatgccaggctacttttgctatttttagtagagacggggtttcaacatattggccagggtggtcttgaactcctgacctcgtgatctgcctgcctcggcctcccaaagtgctgggattacaggtatgagccaccgtgctctgcccatttaatctcttaaatagggaggcatgagttatgactttaaacaccttctcttctagcttctgatggactaaacaataatctttaaatacatttcaaaattatcagtttagtagatgacaatcaaattggaaagttttgccagtttcttatctagaaaatgaataactgcactgtgagaaacccactagctcagagtagaatgttcactatgcaatgcagtcatgggcatttttagtcacggactctcttaggtcagtaattgagttcttttctgttacttcttggctccaggcaaaagcaacatcaaaaatgtattgatttttgttaatttagggagaatttattgaacaaatgcaagtggtcataactaatattgagttcctctaaatgtcagaaacttcatatgcatttttgtatttatatctcacaatgacctaatgtgataagttccactattatctattgttttatagataaggacactgggattagagaatttaagtaacttggccaaggtgacacaagcagtaggtggctaaactgggattaaattagatttaactaaaagctcaagagagttattttttgagcccctgcaagattgcaagttccttaaagatgacttaagtggattatttagcttactcatctcattatccccttagtatccttagggtgctttgaagtacagcgtttagacaatacagtggggtggttaagaacctctgttaagccgcctcagtatgaattctagtttatccacctaaaacagcattcacagattcccatcattttctgtccatttcttgcttaatagttctccatagcatttatcattacctgaaattatatagttttacttctttttttctgggtccctcactagaatttaagctgcacgaggacagtgaccttgtaagtcttgcttcctaacaccaaattctcaatagctagtacagtgcctggcatgcagtaagtggtttaaaaatatctattgaatgaataaataaaaggagatacattttgcttaccgtttatgcctggagtcgtaattttcaatacaattaatgggccaaatgaaccctaccttttttcttggttcagcttcaaaccttctttttaaaagtgtatttaatagacactaatatagcacatatgctttggaaaactccattttatgtgctttacaaatattgacccatttaattctacagagaaggtgaaatcattacatccattctaaaggtgaggaaccaggcacagaaagatttagaaacttgcccatggtcagacaattaggcaaagaatggagccaagattcaaactcggatagtctgaccatgttcccaaccattccattatgctgcttcctagattaatcccataaaaatgtcatttccctggagtttaatgctctaaagatgtgtctttgctctcttagagaatgaccttccatcttgcctatttttccttcctctctacccagattaagaaggaaaataaattaagattattttacttattgaaacagcacagtatgctatcagtgaagcttctctcaggctaccttcaaggataaataagtgaatgaccccggtggctgctggacagctcacatggcctatatctgcttttcttctttttcatatttgtctttttcttgtatttctagagctcttggattcctgctgcaacccttccttctagccttgagaagggagttcagtggtccatggaggctgcaaaaactgccttttaagcctgaaatgtaaaaggaaggccgattttataaatgattcctgttcttgcttttagtcaattggttctttcatttcctgtcccttttcagtttctttcacaaacacacaagcaactcacagccttgggtctctgatatagcaccatattcactcaggaggcaattgtcatgagcacagatatctgggatttagttccagttcagttactaaggagcaatcttccttggggcaagtcatttaataggactgggacttagtttcctcacctgtgaaatgactccagtgagaggaagagctggagatttaaaggtcccttccagctctaaactgtgattattctttgacgaattatgtaaggaagggaaagtgctcagatatctaaagccctatttctctcactacagattgcaggataactccaagggagccactgttctttattaaatgggggtgaacttctcagaattgaaggatgacggctgctggggatagcaatagatcagaacctattttcctgcctaattccttccctatttctctgtaaatatcagaaggagattaggagtaaaagtgatatttcagctctgtggtctacataataaacgattccaagataaattcttaaaaaaaaaaaaaacactaaaaagttctgcctctttagcttgggaagaatgtagtagccatcttgctttgtgaaactgcacaaaaaacttggagcagagcatgggtaagtatgtttgaattgcgtgctctcacgcccagcagttgtttaaaaatctatccagcccatacagttattgcgattttgcattttgtacatatggggctttgtcatttcaaagggtgcaaagagcttcatgaacaatggccattccttctctcgatgtgaccccgtagaacagactagttattggtcatcacttgtaaacaggaagcatgaatctcaccctaggaaatgcaggccgccagtgctgtcatgcttacatgaaggacatgccttatccctttgtaaaacatttaaaaataaaggcactcagtttggaaatatctttgagcatcctaacctgacccattcagaactgacctctaatcagcatttttgtttggctcagtccagtctaataaatattaactgggcattactatgttcatgatctgtgtgctccatacctaggaaaggaagatgaacatggccaagatcctaatcttgagtaagagacaaattagtcaacaggtggtttttatgaggtgtaatgggaacacagaagggttaaatcatctatcccagagagaagatgttgtaaagatttctccaaggcttaagtattaaggaatgaataggagttacccatgggaagaaggatgagagttaaggtacagaaggagatgatgtttctggcacagaatgactagattctcaggaattctatcacatattcctaggaagagagataatacttcttggcctaatttgcagtttaatgagggctatgaacctgaatcctggtgaatcaaatgtgatttaaagtaagtgatgcatttcctgtcctggcaatagaacatcccaagtgatcttctatgttcctctctaccctgctgtcatggcagcccacaaagaactccaggatggaagggtccatgatggaagaagccagggtccctgaattactggttggaggagagctgcctgacccacactggacttagcatgtgtgagaaataaatttaacagtgttaaaccactgagaatttggagctgtttgttacagtggctaggttcattaccctgatcatactgtgtgccaggctaaggaataataaaagggatctgaatgacttgctgtcacttcaacatttatatagcccaaataacttaggtttttgaccttaacattgattactctttcttcctttctcatccaatggcaccaatgatttctttcttaaaaaggtgatcttttacagtctttcagcaagtcaactgctcctcctgagtatattatcagcatcttgtgtcttttaatgacatttgtctattgtatataattatataacattatatctattattatatctattattgtataacatatataatatacaacaaaaaatgtattatcgtatatataatatatgttttatattatatatactatacatttgtattataaaatatatatcatattgtatataataggttataataggaatataatatgttaatgttatacaatatagcatgtatatataatgaaatatcatttcaaaggtatctctatataaaaatcaatttttctcattagaatacacattttatgagggcaagggcttcatctatattactcattactgtaaccctagtgctaagggaaatgactagtatatagtaagcactcacagttattttcagaatgaatgaataaagataaatataatagaatagaggctgggttttttaaaagaaatggacttcagctgtgttcagatgtaggcgttctgaaggcagaaagagctccaaacccagacgagggttgacagttgctcatatgaaggtgatagcagaagctatgcaggcaaatgaaggcgcctcaggagggtaagggaaggaagaagatgagagaattaaggctgaattttagggaatatcaatgtataaaatagactaagtataagcagctaatgaaacaatattagaaaaagtaaggaaagtaaagagagtattgcggcacagaaacagaactctgtaagaatcacagttttggggtcagatctgtgagtacagcatattcaataaacacctgtctattgattgaaataagtgctgaacactgaatagcatatagtcccatgaagatggtcaaaggggctgactccttttctaaaagacatatagccaatgtcatccctgttaattatacacatttctctgggatgacatcaggaggcttgggttaccctggggcctttcactagtctgataaagtaggctatatttctgatctgagttcttccctgtttagaagattctcagaagtatggaaaagttcttaatctagctggatatttattgataagttacgggtcagtaaactatgcctacagtctaagcctggtctattgcctgtttttttaaataaagttatttggaacacagccacactcattcatttctgaatcatctatggctattttcactctgcaacagggttgagtaaccacaatataggacatatggccagcagagtataaaatatttatgatatggcttttcacagaaaaagtttgccaacccctgagcactgagcatatctgttttgcacccccggcaaaaaaacaaaaaacaaaaatacaaaaagcaaaacaaaaaaaaccccacaagacattttcagaactgagtggagcttgtaagaaccctgggaataccacagcctgtcttactaaggactggacctataggaaatagaatattctgtgccttcggtgagactgggtcccgtcatgtatttactttaggttaggacctccatgctaacagtgcacgtatgtgggtgtgagattctctttgaccgtgtatctttaactgatgtccactgggtggtaggccaacactgagtggcagtgagtttaagacatgcaataaaaagaataaaaagaaatgcaagtgaaaagaatgagggtagatggagagtgagtgatgggatgggagaatgaaaataagtcgccctgtcaaaaggtaccatgagagcatctatgcctgtgggctatattttgtcattgcccttctgaaaaataccagaagaaataagaacaagtttctatcatttttctaagtgacagggaaataagactgaaccttcctttctagacttttaaagaaataacattggttgtacacttttccgctaaagcgtacacacatctgcgtcaaccatcaagcctagaatcaataaacatctgaatgttaaggacttagagagcactagcgtctttaagagaatgactctgttctcttgaagatgctagttctttcaaggtccttaaaattatcttcatagaatgtctctgttctcttaaagactctagttctttcaaggtccttaaaattcagatgtaacttctttgaaagaatgtcacattcctaatactcctttcaaaggctgaaataacctgtgatctcatcatattaagacatttctagagtgattctcttcatctatgacataggggtagcagagtgacacctataaccaaatctggcccccaatgctttgttttgttaacaaagtgtttatgaaagaaacccacagtttttttggggggtgaggaggggcaggacttctgctctccagtgtgccacagtttccaccactccatattgtcttttctttaaaagtgtttgagttttcaatccctacaatctctgcccacaccattttgagggggccaactgttgctttgatctattttcttcgttcaggcctaaaattaaatgaccacttgtaactttctagctatgttagtttattagaacccgttttatttgctaacattcttcaagttttgtccaatagagtttagtagactcactgacctaatatatatggtaaaatactcttttcagtaatgaggcaacaatgaagaataaatacattttaagaaactgtgctgttttatgggattactgatttgtgtatatcacttagatcagtgatgttcaggttatgaagtgattatgtacaatttgcaaatatctagtgtccctaacttctgtattatcttatatcatgctacattatacctaactctacagaccagagacatgtgcctcttttttgagtggcagtagcaaaggtggctcttaaatcatctgactgtgaacaatacagtcccaggaagatggcccaaggaaataaagggtgtttttttccttgtagtttttgacggattattccattttaactacaaatgtggacaatggaaactaggctgtaaagtagatcattataaaatgtacctggccaacttctaagatgtaccccaccctgcccgccctaccccatggtccccaccgtctggtattcacgcccttgtgtaaacacctctattatgtatgaactgaatctggtgacttgattgtaatgaatagaaaatggcaaaaagatgggatgtcacttgtgtgattaggtagcaaaagactgtgacttccatcttgctagcactttcttgtcttctcacttgcttgttctgttgaagctagctgcatgttgtgagatgctctatgtggtgacaaggaactaagggaggcctcagccaacagtgtgtgaggcactgaggcctcagtccgaaaatccctaagagcctgaatcctgcctacaaccatgtgagtgagttaggaagtagatcctcttgacttgagtcttgagacagctgtagctgtctgaaagatccagagacagaggacccaatcaacattgtacctggattcctgacccacagaaattgggagataataaatgttgttatatgccactaaaatttggggtaatttgttctttaacaatacagaatataaatcatctattggaataacagcaaaaatttttttagccaaagcctcaaactgaggatagagaagggggtaatttaatccattcattcagaggttctcagtgccattcagtgaaaaaaataaatatatgtagctccaataaatattggttaaactgagcagaactcagaagtaaagggccactaaaattcaggtgttcattatgtagtaaagtaacagtagcaatgaacaaaagtgaataccagacgtcgcactaagatcaagagtcctgtgataacaatatttactagtcatcaaatatttttgggtttgagttttgaggaactccaggatttaaccgaggagaatgagtaggcagagagacaacagcagagatgcagagagtaactacgtattgtggaagccgaaagaagacaatgttaatagtgaaaatttgccccatggggttaacaagaatccttgagcttgccttgcaagaagacagacgaagaaacagcttgttataattctctctgcttgcaacaaaactggctgactggctgaaactggctggaaccaataaggctgactggagtcagaatggcacagaatagactcgctctcctggggggtgacgttttgatgtcacagcctgaatttccacgtcatgtttcagaccagttccccatgaatttgcacaggcaacccacggaaaagcacgaagggacaactgcgcatgctcaacggactttccaaacttcccattcctttctgccaatcactaaccaaccgggaagccccgcccccagaatctctcccttaaatataccgctttaaggctggtacagggcgacggatttgaactggattcctgcctccttgcttggccgccttgcaataaacctttctctctacaaaatccagcgcttcagtgtttggccgcaattgtgtgcaggcaaatgaacccagtttggttgataacaataattgtcaatagtatcagagtctgctgaagtcaaagtagggtggagataacaaagggcttatggaatttctgatcttctgcttactggtgaccttagcactggttgtaggaggtcgcagcagagaaacaactcaagcccttgagggattagtggagcaaaggaaatggggagacgttgagtatagacaactactaagtaattccaaaaggtattataaaactggaaagcattagaagaagaaatattgaaaaacagcgtgagcatacaatataaaagttgcttatgtgctgaaatatactgtcaactcaggttgagggatatgaagagagcagatgcgatatgagccttgacacaaagtcctgcaaacctttaaaatgaaaatcctttgaatgcctgaccttcaggtgttatattatcaaaggacagaagcgtttatgcccttttaaaaaggaaaatgtattagaggattatccaaagacttggccacatacaattcttttctggaaaaaactaagttttatgttgaaaataagtaatcaggtaatatccctgtgtccaaagagacagaaaaagcacaataaacttaacatttctaggacagtagaaaaaaagccattttcttgtggaactttgggtttgtttcctttcataaaaagggaaaaaggtgaaatttgatcttcaagaagtccaggaaagcttttagagctgagaaaagacagagttggggttggtgagggaagtagactctgggtgaaaacggataattaagctttacaaaaggtcaagcattgcaaaagacagcgagaaagatgcattctatgtgttgaatgtatcaaatgtagttgagaagatgtaaatcttcgcattggtgaatatttcagtattaaaaaagacatattaaagaatagctattcttacaaaaggaataaacttttttctttgaagcttgacacaacatatacaaataaaagcatgaaaaatatgctttgaagtgtgctaacacatcaagattgtactgagcaaagcaccttttctctgtttaggaacaatctcactaattccacaacacaatatgttaattaaaggatcccaggtagcaatcatggaatatttcttctcatgacagatgaagaatacaaatattctgaagactgaaattgtataaacaaaatgaagagacattttgtccgttttctggcagtgcaaagttaaagtgaatgcagatgaatgtgctggcaataaaatgacactattaaccatctgaagatcgggctcattacctaagaaggcaaagcatcaatttgtggcattacaacattctatttgtgctgctcaatgtgcgtctggatgtttttatatactctctactaatttgtgtgcagagtgagctcttctgcatcagcctctctatagaagcttaattttgtattgtttctcttatattattttctctaatgagaatgatattctgtattagaaataaacacttcatttattcttcaaataattctacgttcagtttctcttgttttgcattatcaagtggtgtgtacaggattacagatatatcttaaaattgaggtgctctgattaaaaatatacatttgaatgacatgtgaggaaaatattcattcactcagtcactcactcattcattcttaaaagaatgtctatgtattgggttaagcatcatgggaaattcaaggatgttgcactgtctctgccctcaggatgtttatagcatagaagtggctgaatgttattagtaccttgagataggaacaaggacagggccataaaatctcagaggaaagggaaggtcagtgtattttctcataccacaagtattacttgggtacctactatgtgacaggtgctattctagaggctggatatatagaaaagagaataagacagtcaaggtccctgaccttatggaccttgcttcctgagggtgagatggaaaataatgaagaaaaaaagcaaataaataatataacttcagatcacactaagtggcatgaagaaaaataaagcagagcaatagcaagaacagtgatggtaagggaaggatgtgaattttagctcatgaaggcccctgtgaagatgtcacattcgaatagagatttgacaatgtataggagcaagtgtatgaagttctgaaggaagggctttctaggtagtgggacctttgtaggacaggataaagactttattctaagtgggaaggaaattcactggagaattgaagcagggtatagcatgacctgatttatattttagaaggatcattccagatactgtatagaaattcaattatagaggggtaagaaggtaacctggacagaggttaagcatctgtgaatagtccaggatagaggagaacaatgagaacttgattcatgtagtctaaccaaggatgacagactggaatgcactgtggtagtccatctagatagaggtggttggtgaggactaggttgataattacttagatggtaaggagcggttccattttgaaggaagttgcacaaaggaagtgatatgatatgataatatctgagttgaactttaaatgaatggcagcatgtgacaaagcaagtagtcattcatggatttgttgagtgcttatctatttttatgaaccaggcactgtgctaggtgctatagatacagcagtatggaagccattgctgaaagtgagaacaacaaaacttgctgagaaggtaatattttaagtaaacatacacaagcagagaggtgaacaatatgctcataggaattacttcctgaattggttctaaggatgttttattcttttccatttagtgtagaaaattatgtgattaaactcctttgtatatttggctcagtgaatttgcaaaaggagtaagtgtctatcagtagaaattcaattcactgtcagttgggaaatttcatcagacaatttccttagaaatagtggctaatatttacttttcccacttagggagggagaaagtatagcctctctagaaagaataggaggataggagagtacaaaacctaggacaatctcaaatatccaggtgtatctattacagttcatctgccacctgcctccaatctgccccacagtctttttgcaaacagatgacccaacttcaactttccctccttctaatcccacttgtacactgcctctagaattaactggcctaaagtagtccagtcatgtccattccccagtgcctacagaataaatttcaaattcctcagcctgacacacactgacccaacctactttttctgctttatctctgactacacacttctcaattgttttaatcaccttgaattttcttcctctttttaaaattattttttgaattgcatgaatatgttatgaaatacacataacataaaacttaccatcatcgccatttttaggtgtatatttcagtggcatgaagtacatttgcattgttgtacaaatcccattggattttaaatgtctatttccctcatacttccagcaatttgttgcctgaaccaaatttgtttttatatggttcctggggcctcctgaaatgccttttcccatccaagtactaaccagacccgaacttgcttagcttccgagatcagacgagatcgggcacgttcaggttggtatggccatagatctgaaatgcattttcctttccttatcaattaaaatcccacatatctgaaagattcatgctcagattttgcctcttcctttaggctactttgacaccttatctggaaacaggaggtcaactctgttgctaggtaacacactgcttacagtaaaaatgatgcctggttggtaaattgcatctggactaggagggcctatacatgaactataaatacatgatggggatgtgatactttggacttccctgagtaatgactcgtgtaattaggtcccttgtagggaccatggaggataagtctatggagttgttgcaggagatatcgtctcttatggggcaggaggcttttaagccagggccattcctgcacccacccaatatgaatctagtcttcttgaacctgagctgccacctggggggccagaactgatatttgtactgatattaggactctcactgaagagaaaatctgaagcttccctggtggccagcagtgttttctgtatcacatttttctaggtaaatctcaagctaagggttcatgcctgtaatcccagaagtctggaaggccgaggtgggtggatcacctgaagtcaggagttcaagaccagcctggccaacatggcaaaatcccatctctactaaaaatacatacacacacaaaaattagccaggcatggtggtgtgtacccataaccccagctactcaggaagatgaagcaggagaattgcttgaacccaggaggtggaagttgcagtgagcctagatcataccattgcactccagactgggtgacagagagagaccttgtctcaaaacaaaaaaacaataaaacctcaagccaagtgtggcccatagtagtctcataagtctgaatgtgcagttggacctaagaagatctgctcttgaggttgcatcaatatgtagaactactgtactaaatacaaatactccttgcatgcctggactcaaaatcactgggaaccgtacacaggactagggcaataaaagtattgctcacctttggaaggagctggattgcctgtagaattctttgtctgtgcccagaattaaggattccaatttccaacaaatcctgatcttccataacattgcttccctgaaacaaaacagaaatgttacaagttaaatcaagcatttatactgtggataaataacaaggatttatttaatacagagaaaaccagtgagtgacctgatttttatgaacaaagacatagagtcattcttccgtgagggtgagggcagagtcggtcaccttgttactgatgtgaagtctaggagaaagctcccctcccctcacaaatatctatcgtggcttatatccacatggggttatctgcactggagattcattcgtgtgacttaaaactttgtttctgcacattgtgcacatgtaccctaaaacttaaagtataataataataaaataaaaataaataaataaaaaaagatccaaaaaaaaaaactttgtttctgtaaaaatgtgaatgcttctagtaagagttgccatttaagattatcagtgacttacacattgatatgaatgaatcatttttccccccttgatgacagattttgtgcggaaggctgatagaaaaattgacatatattaggcaggttaaaagtgagagttaatacttaatttcaaaatattgagtcacaatagcaaacacatagaatcaacctaaatgcccatcagtgatagcctagataaagaaaatgtggtacatatacaccatggaatactgtgcagccatagaaaagaatgagatcatgtcatttgcagggacatggatggagctggaggtcattatccttagcaaactaatgcaggaacagaaaaccaaacaccacatgttctcgcttataagtaggagctaaatgatgagaacacacggacgtagaggggaataatacacgctggcgcctgttggagggtggaggatggaggagggagaggatcaggaaaaataactcatcagtactaggcttaacacctgggtgatgaaataatctgtacaacaaagccccatgacacaagtttacctacgtaacaaactgcatgtgtactcttgaacataaaataaaagttaaaaaaattattgaatgccagacaccagatcacgatatgaagattgaatgatgaatatgatgcagggccctacccacaactgcctttattccttccagtcccgtgatggaaagggactgttcaaaggcagttaggtaggatgctgagactgtgctatgatggtgacacttgcttaggagtccagagggaatccagggtattttttcagagaaaaggacatctaatcagatataggaaaaatgggtggttaaggcatagcacctaaaagaggaaggacaatggggaaattatgtgcaaagacctgtgagtaagaaggaatgtagtatacttggaagcatcatgttctgggataatatggagagaggagcaaacggtaaggctgaatgagtaagcagagggcagaccatacagatattgcatgccatgctgagggcttcagactttatcctgaccataatgggtagccatggacagcttttaagaaagagagttacatgctgagattccaaatttagaaacattattttgatttctggggctgggcctcagtttccctacctataaaatgataaagttgagcccacaatgtccaaggaccagttcagtcctaaaattctgatttcaatggttattttaaacctgtgattaatatttgaatgcagaagtttacatattgctcattttatccctagattttaatctttcacggtttgtaagacagagtttctctttaaattgaggcgtctatagaggttcaagaattcagatcactattttttttgacaaatcaaactctgtcctacttatgtgtaacacaaaaacgcaagaatagaaatgacagaatatccatttatttagtgatgagtaccattagacactcaaagcaaaggagaatgaatttgaaagggtgattctggggcatggagaccactgtggttgttttctagaggcgctgtgggcatagactaacgtagtagtcacaggagcaaaaagaagcaggtggatttgcaaactatcaggaagtttgacgtggagattgaacatgtggaatgatgcagaaatgtggaatacacaaaaattcaaggcttgggcagtgagtggaacttgatgccttttcctgccataataaaggaggaagaacagccctggtggggcgcaaagtgagactaacatctttccctggacagggacagaatagatgcatgtaaacaacttaataatatcagactatgctataaatggataactggctgtgcttagaaggattaaagccactggaatggcacaacagctagggatttaaaacgggcattcactggacaaaagcattccacctactcatagtgtcattcttatgcttaagcaacaccagccatctcggaggaagcagaatgatccaggtattcagcagcatgataatgaaaagcctaatgaaaaacaaataaagccagtcttggcaacatgccacaggaaatattgctctcaagaaattactcagtgcacacaacagagcatggctgagaatacaaatgacttcatttagagaaagcgttattatttccagaaatggactagtatggcatgagcgagatatgtgataccattctgacttttactctttgaggagttacctggcccttaagaaaaaatctttcgtcatctttgtgctagaacattaccaggttttccaggtcctaacttaccaacccacaacttcagcccatgtagaatagaggacctggtttttttgcagaaacagaaagcatacgaatatcccatagtgtgcatagctactatctctaggtaatcctgacaactggatttcagtgtttgaatactgaaatgttttggtaaattaaatcctaaagatcactgttcttcctctacacctccaatatgctattttctgtatctcagtaagagaggagtccttttgaagaattatagggaagttagatatttttaaagaaggtgttgagtacataagaacatctttttgagccaaatttcctagcatataggataattgccaaacatttttgaaaaatgaaccaaaattatgggaagcacaagaaaaatagtgaaaatgtgtcaaaggggaaatggcactaattgggaaatggaaaggaaaggatttactgtccccagtgaggcatgctgttagaaattttctattttatctttttctataatacatagggatgccaaaaatatcctagtacatcattcagccagccttttgtccaaacactaggggacttggagtctgcagaactgggtttggatcatggcggggcaaacttggctaagtcatacattctttgtaggcttcctggtcctcacccaccaaatgaagcagtttaatgaatatgtattcagtttcaaaatgctatgatttcagccatgtttgatttttggttggtatcattatatataaatatagattgtatattttgaaattatgtttcagtgtttcagaatttgtaacctaaaattagctttaagaagtgattaaagagaaattcaagaatatatatttttttttgacaaatcaatcttggtatgatggacttataaaatttcttattaaaggaaattataaggtaacttatttttgtagtagtacggattcttatagcttttcagggaaaaacaaaatgtttcaaaccttataactatctaaccatttctttggcacctgggtgacagttgtgccatcaaagacaataaacattcccattcttcctagggagctggaattaattctcactttatcacttgcctttactaaatgctagcaaatctcagtttaacttctgttttttttttttttttttttttttgagatggagtttcactgttgttgcccaggctggagtgcaatggcacgatcctggctcactgcaacctctgtctcctgtgttccagtgattctcatgcctcagcctcccaagtagctgggattacaggtgcccgtcaccatgcctggctaacagggtttcatcatgttggccagggtggtctcgaactcctgacctcaggtgatccatctgcctcggcctcccaaagtgctgggattacaggcgtgagcaaccgctcatttttctcaataaaaactgaacacaactctagctttcttcctcctccatcatttttttttttcacataacttttaggtcaatgatttgggggcagagctccgtcatgtccatcttctgtttagtcatctactacactgcactctcaatctcctttcctacccagtacactccagtcccatgttttcatctcccattttcctcctcaacccaccagaataagctgttcccccccatcaactccatagaacttctctgtcaaatgttaagaatgacccctcaattgccaaatatagttgattcttttaaatcttgatttcaagaatttacttgccatatgtaggtgatggccaccatattggacaacaaagatacagaacatcgccatcattgtagcaagttccattagacagtgctactctacagttagagacattgaaactttagtcaaatcacaaaaatggggcagtagcagggaatcaaatcagggactcaaaaatactcatgagtttttctcaggatgtagttattcatgtgcctcttagtcaaagttcatgaacattaagtttaggatctttagcaaattctcttttaattcttcagtcaccaaaagaaattagaaggttgttctactttcagcaacatttctttatggtggggctataaatctatgctatgaaaatgacaagtccaatcactaaattatttttgactttcttagcatccaccaatcacactgcataaggtgtttaaataacaataatcaataaataaagttgtttagttaatgactttctagaatgatcaaagacccaaatgcagtatttttagaatagctgttctttgcctgtcaagaaatgtctaatgcagggtgtctttattgatctcttaaatcatggaatggaaaaagtcacctaatgttttatgcactaatagctgaaagtggaagtttctttgaccacggggagaatatcttaggtactgaacttcttcagctgtgataaactgttaggatgcccaaatagaatgaaaagcagtgttttgtatttaattattcattagaagtaaaacagctatttaccaaaaacatctcaaaaatatctgtactgatggctctgtctctccaaactctgcatttaaaatttcttgtagttttttaaacttaatacgatatcttattcatttagcaagctttccttcatattatatattgtagaaaatgttaggaaaatatatttaaggaccacagggaactggcttattcttaatataaacttgagttggataatgttatttattctcttccttcatccagtccaagactaaaaaaatcaagatgatactgttgattggggaaacttgtttttgctctataattagctaaattagattcttctccacaatttatgtgaccttaaatatttaaaatagaatcactgtataatagaatgacagcaagatcttacaaacttacacatagaaaaacatgtactttagtttgcttttaatatttagccttttataacataaatagcatggtagcatgaaactgtacataattttcttggaataacaatgctacctctctgcttctataaaagctttgagtcaatttgatatcaatttacaagtaaacccaatgcatgtcttctctgcatgattatgataatggttattgtgctaaataccagatttattattcctctgtcagtgttggaacaaagctttatttagcttatcatatagaaacacgggtgactataactgatcagataatggatgatgtgcttcttccaactttaacttcctctctcacattaatgaaatggcagtggaagaaaattctatagtacactaaaaaatccctctaccctaatcctccatttaaacatattctgtctaccgcaataaaatttcttgcatacaacttaagtaaattttcatgtttttagcttatgaagaaagctttctggattcttcagactatgtggactattgattcaaaaaatattacatcactgaccaataagacatcatcttatatgtgcaagctgtgtattttaataaattatatcttaaggttaagatatagtttagcattatatatttaacagctaccatgattacaatgaattttctgtcaccgattttttcctctttatttttgaaacccaattcccctttgaaacatctgttgtcaagctacagagaaagagaaggaatttaagtaaccaggtatttatttgttaaagtatcgagcaggatttggtgatatcataaattataaatgtaattcacttgagatgtgttcatgtaggttttagaattatgtgtatttgtaaaagagtgcaaaataatttatacagtaatttgtactgcctttggtcaaaaattttatagctatgagagaaggagcctattcttcatttttaaggatgctaacccagagctccttcaagtaagaagaaaagttgatgtgaacaaaacttttttgtatgctcttacttctctccagatgcatatatctgtataaatataaagctgatgaatacctactgtcttccttcaactttcacactgatagcagttggtgttcattagtgtaaagtaaatagcacacttactgtgtcaggcactgttctaaataccttccatatattactttatttaattctcacaataactcctatgaggtaggtagcttgttcccatagctgataggagactttctcaagacttaccctatactacctctagcaggaatcatgcaggagataaaaggttgagttaaaaaaacatggttagatccacaccatttatatttttacttcagagtcatctgaaattcacatttgaaagcgagtgttccaatgcatttatgtttgatttcacagtaccgaagcaacaatgaaccctctctatggaagagaacttggagagctgtctggcctaatcttccctgctttgctccagtcctttctgttcactgaatcctggaatcaggcttggcagggacctggggggtttctagtttctagtctaaacgttccctaactacccacaaagcttcaacttctcttttgaagtgtggtgtctcactgggttgacaccatccccagagaggtagggaggatattaaatgctttaaatggtctttcccagcagctgagtctgagcagggggtgcggctggggttggggtggcacctctgtcctactcttttagctcccactgtggtacagaccaagtgttgcaggagagctatctgaagaagaacgtgccagaagcggagatgaaaggaaaacagttagcagctgtcctgtgtccttttgtaatcacaagctgtgaagctgaaaaaaaaaaaaaaaaaaaacttccttgggtaggctgtacataatcttggcagatatctgagtgttgttcttctgtctaatatgctgaacgtttcccagtgcctcacaagagaaaagtgagacagggttaggtgagtttggacaccttgctccgaacaggcagggaacatggcgcccttgtacgttcatcaagctcttgcaaatgccctgtcactgtagatgctgatgcagagctccaaaaggaagggctcctctgcaggagaagcaaaaagaatttgctcctgggtattcccaacacagccacatataatgacgcagaaagaagtacctaaaaagattaccagccattacattcactgtgtagcaggtacttcacccaccttatttataaaccttacagcactcttgtaacataggtggtattattttcatcttatagaggaggaaactgagtctcagagatgtgacactatggagtcaagttcacaagataagtataggatggatctgggatctgtgttttatttggtcagactctgatgctgatgcttccttcactacataaaaagaaccaaatgtttagtaggggacattttctggatggagattccggtccatagatatgtaacgttaccaagaagttactcccatgaccctattttcacacacacaagcttacatctatatttacagaccatagggagtgactgccagagtttctccaacacattgaatttcacataaattatttatcttctgaaaggtcaactggttagttctccttctaaactaccttagtgtattccagaaccaaacatgttaatcaaagtgacccaaggtgtttgtggctaaagcactaactaacttgccatgtttcctgctgtgaggcaggaagtatcagcatggcattaggttgttgtgagagattcagctcttctgcagtgccttgtcaaacgacctgactggtcaactgggaaaatgaagttctcagggccaacatcgtatttgggtgtttttcttttaggtctgtatcaaagccagatttaagaaggagggtgtctacaaatgaacgaaagcagaggatgtctggggacaagctaaggacatttgtgtcccacactgcatgtattctgaatccagagaaaagagagtgagttgcagtctcctgagaaggctatccaggctaaggagcctgtgatggtgaaggtggataatttagccctctgagaagtgtagacctgtcaaaaaggagattcgttaattcttcaaagatatggttgtcttcaaagaacagacatccccagatttaaggatgatggggtctcttgacactgagaactacattcagaaatagccaaacaagaggaaaggagcaaagaggaagagaaagggagggaggaaatgagaggaagtgtttattcttaagggtgaaggtagtggtgaagggagtagaatttcctgataaaatacagaaattcaaatttaagtggcatcatgtatttttattcacttaatctggctgccttagacaggaggtcactgaaatctggaaatgagctggcagagtccagtccagagctaccactgaggcaggcattgtcattcattcatgtagtcagcatttgtttgttcaataaatattttttgagcatttattatgtgccaggcactgggctgtggttgtgagatacaatgagatcaggacagacaaggtccctctacctttagaatttacagtctagtggagaaaaagggaaacagtggaataaaaaaatagataaataattatttagcaaagttttactatataccaagtatttactgtattagtagggactattaagcactttgtcttgtttgttgttcatgataaattctgatgttagtatatacaattattatccttatttacagataatagactaagaattgaaggcacagaaaagctgataattagtctaaggtcacacaggtagtaaaactgacataaagggaatcaatggagttctaaaataaaaaataaacaaataaataacaacggagatctatgttagaaagactggtgaggaaagtctctctgagaaagtgacatgtaattaagacctgaggggattagaaggagcagcctaactgtgagaagagctgttacaaggacattccaggcagaaataacagcaggtgcaaaggcactgaggtgaggaaaaaggtgaggcatgttttaggaacaaacagaagcctactaagaataaaatttagtgactgagggggacgaagacctgggaaagaaacgcaggaaataagacaatacagagacttgcagactctgataaggactttgattgtattccaagtgcaatgggaaacattgaaggaaatatactaatttgcatcttcaaatatactctggattcggtgtggagaatggatggagaaattgggaggtatggaagttgagctcgacaatcaaaattgaaataacagcctagaaacataaataatctaaaggaaatgtgatgaaatatgaccttttgggagactatgggaatgggtctcactggggggggggtcaagtctccaagccaaatgcatcttttatttgaatcaaagagaaaagccatatgacaaggatgaaatcagaatagtctttgataaaggttctatgtggatacaactatgaataaagatttagcagtacctacgaaaatgaaaatgttcagactccatggacccagcaattctgtttcttggtcgtggcagacattgctgggaggctgagtcctttccctctcactacctcccactgcagaggctggataagctaaagttctcagcttccctttaaagcaatggttgaacatgtgacagaagttgtcattggggaacttctggaaaagcttttgctttcctaatgaaaagggaaaaattcacctgctacccttctgtgcccataagaaaggactctcctcaggatgagtggctaaacagttcagagaaggtgacagcgatgggcccacagtccttggacctccaatgatagatatctccattggatacctggaggcaggcaaggataggccatggaagggttagttctgcataaaaaacgttatttaaagctctctccatcttttgcatctaagttgctctgactagtgtttatctgtcagtgaaaataatgatggggatgtgtactgtggcatgtaattaatagaggttataatggaggcaacaggatatttactatttattttaggcagacaggggtatgataacataaagaatagcagagaagggatactaggaagaatgaaagttatcagatccaagttggggtgtgtgtgtttgtgtgtcaattatagcattgcctcttctcattttgacttaacgttgtgaatttctcataaaaagatgacttgaaggaatttctttactctggattttggtttctattaaaaactaaaacggatgcaaaattgccaaagtgctcatgggactaacaggttctaaatctgggagtgggtttcagcttataattgaagatgacaggtgtccagagattgtatgaagttatggttctaaaggaagtacagttttacataaacctggtattctacaggaaaaaatgttactcttgaaatccaaacacattataatcataacagggcagaaacaataagaacatttaggggtatgttaggttgaccttagtgtgtagctcttccaggaactcttgagaagtcagagtttttatttaggtcctttgtaatctggaatgcctttggtgggcagtgaatggcgattattgaaagagttgactgatagaatattcctgacttttccccacatttatttttagttttggttttggtcttgaagacatttttcttaagatgtcttcaggaaaaaaaaaaatttttccacattgaaaactttgttttggctttttcgagtttaaaattcggtgatgggaaaacttgctcacatcacaacaatgggattaagtgtgaggagatgatcgctgtgggcagacaggcaggaggctaaccccacgaagggctaaactaaaagctgagtaagagctccactaagaagagctctttgaactgttctgggactggctagggccactaattgtccttgggttgtatatgaagggaaaatttgtatcagggacacaaatatccttgtcctttgtatagcatctatatcatgaaggatattctcattttttaactccattttcttcactgaataatattactcaacctgaaagaaatacaggggaaagaaacggagggacatgcattctcacagtgaatgtaattaaatgtcctcctgtctagtttttcaagttaaaggttctgagttttgtttccagaatattcaactggtactaaaagcatcatgaagtccctcatatttaattaaatggtgcattattaaaagggggcacactctatctaggttaaagaggtgataaacagctatagaatttcatgtttctttctacttggtattatatgtcttgtttcctttactggacagcaaacttcttgggagaaaggatcatgcctgaagcatctttgcatctcccctaacatctgtttgctaagtgttgaataaaataaaagcttgaaagaatgaatctgtaagtaaaaacatgagttttttagatttattaaaaaacatttagtctaaagatcactaagtaagtttataggaaaagcactgaaattttgagctggaaattctaatatgcaggatgcctgatgtgtttttcccccctaattgaaagaaagataaagatggaattgctggtacaccataacaccaaaatgttcttaatttttttttcagttttgcaaattctcatgatttgattttcatccaggactgtcagttgagacatctgataatctaaaagcattcagagaattaggatcccatatggctcgaaaatatttcctatccggcaggaaaaagagaacataccatgaaaataatactggtatatccttcaatttatgtgtacaaggagcataaataaatttaaatcattattcaaagtataataattataatgatcataaggttgattataacaaccaaaataaaaagaatatacagttcttcataatcatgtgacattataaaaaatcagaagtatacttcaaatcaatgatagtaatagagttgtgtttgtctaacagaagcaacagtcattagaaatgagcacgggattaggagtcctggcttatcactaattaactgtataaatctgaaaaggtaatttaactcccttaggtcttaattttctcaactgagccatgaaagggctagaccagatgttcccttttaacacggcatctgttctggaggttctaacaaggagtacatctactcatacactcctattgcctgaagaataattaattcttcttgctttgggggaaatgtcattttcttcagataagtgttcagtattgagaggtgcacttacataatggtgagggagcaaggagacctgggcttagtcatctaatttcaccaacaaaattattactaacaataacaataacggctattcattgagagttaactgcaggccagacactgtgcttttatcctctgaacaattctataaaatagatatcgctattatcatccccattttacagatgagaaaatggaagcataaagattactaggaacttggctgagatcacacagtaagtggcagagctgctttggaaatgaagatgggtgttggaatcaaattcccctcaccccactggcttcccatagctttgacaagtgtcttctgcatggaattgcctcagagatctgatggatggagtctttctctgccagcccagtcgtctccatgaacctcctttcctacaatttctacccagggattgaggattattaataaaaagaaaaggaattgagtgctcctgggttcaccttacagctctgcactttaatagcagtgtgactcaggatcagcaatcctctttctttgtccgtacaatggggataacactaatgcttatcttttaaggatatggtgacataatgtttatgaagttgctttataaactctaaagtaaaattgctaaaaataaagcatgcctgctaggaactactttttttttttttttttttttttttttttttttttttttttagaacatagcactgtaaatcttctagtttcatgttgtttttgctggaaatagtctattctgaaagaggcagcatgtgtgatggcagaaaaattcagggttcccccccccacccccagctctgccatttacttagctttgtggccttgggaaagtcacttgatctggcatcccacagggtcccatactctacaggccctgcatttggggtttaatttctgtggttgctgttttgaagttcttcctaatttttttctttgagtttgtgtgttataagtgaagtctgaagggacaacggagcatgcgctgggcttggcaccttagatcatgggaggtcttgcttcctgctgcatctccaggatgggttctgccagagaccctcttcattggtctctctatctttagtcctgcccaacctccctttctctgttgagtcctaaaattgctgccatccttcactcctagcaggagtctgggtgccggcagagggagggcttgggtgggtcactcaaacccatggcaccttggggccgagcatggcatcgcccatccctgccctaacaggtagcagcattccaaatcaaatgggtgaccagccagaagctatcccaatccagatatcaagcatgtcctgatgaagagatttaaaaatcctttgcggggtgggggtcccctgtctgctatggatggaggtaatgtggcactggataaaagagatgcctggttagattttctgggaccctgctctatccaggacactgtggtagtcaggagagtgttgggggcctggcagtggggcacctgtgccctgcataggaggcacggtccagggtgcttgcatggggctgcactctcactacaagtgtcttgtgccttggaatgctcctttggctagctccatgcctggagcattctccctccttctaaccgtcctgggtttggcctgtatttgtcttttttgaccagatcaaggcatcctttggataaaaacacaaaatataaactggggaatttggtattccttcataggagttaaatgctttaatattttcatctaaaagtaacattgcacaatataaaaatgaatgacaaaattcatgctaataacataaaattttaatgtttctttacacagaacattaaatagtaaacaaaaaacaccatgacaagtctaaagagagaccacaaaaggaaggaaaaaggtttgtacgtatttttaatggcactctttcccctgccttttgaatagggggccccacattttcattttggactgagctccacagattatgtagctggctgcgctcccaggatgtaaggtttgcataatcacctggtccttgcttcacttcacaggtatatttgcagcagctctgcttgtagttggtaagctcagttaagcaacatagttggactgacttaagaatagcttaccatccaatgatctgtggctttatctttacctttccaagtgggtagaaaaggagtaatgggagccattcccttggaaactactgaggtcatttaaccctaacaaggatgatgcttcactagatgttaattagagatcatttccatttttagttttagttctagaggttgccttaaaaattatgagggcaacaggaaacactgaacttgcctagacttctggggcttctttattcattgacttattcattcacccattcaatcattccctccttcactcacactatcatttcacaacatttactgaagtgctatcatgctgcccacactttaagtatggagaattcaaaagtgattgaggcagtctctctcctaaagaagctcaaagtcactgggggaggggtaaggtggaggtgggatcagaaggcatataaagagattatttttattattgttttgagacagagtcttgctatgtcacccaggctggagtgcagtggcatgatcttggctcattgcaacctccaccctccaggttccagtgattctcctgcttcagcctcctgaatagctgggattacaggcacatgccatcacgcccagctaagttttgtatttttagtaaagattgggttttgccatgttggccacgctggtctcaaactcctgacctcaaatgatccacccgcctcagactcctaaagtgctgggattacaggcgtcagccactgtgcctggtcaaagagactatttttttgatgcagcacatacaatgattatggctgtacagagaaaagattcctgaagtacacagctttggatcaggaaagacattttgggaagcggaacatctctgctacctgctaaatgatgaggaaaagttaaccagaatacaggcaatgcttgaagcaagagagagaaggcactgcgtggatcggttgcagcatgaacaagggcaatgagaaaagaaacggtatagtgagagtgaaaaccagaaagcagtttacagttaaccaggtggaagaaacagggagggagagaccaggtagccagccttgtaagcgatgatgtgaagtgggcttcatcctgtggttctgggcagttggcaagttgttttatgcctggaagggagatggctggatttacaatgtagagagcaaactccagtggctatctgaagtgtggatttgaagggctaaaactggaggttggaagcccatttaaagagctcttgcagccataatacaagagacaatgaagatctggactaggacagcagcagcaggaatggtgatgtattaaagaaatactatagagccaaaactgactgaacttgattattgattaaatataggtattggtagaagacaagtgttaagaataactgtcagcgctcttgtttgggtaactgatggttaaggagtcaggtgagaaatagactttcagaggaggtagagggtttggaggtacagtgttttgttcttgtttttgagacagagtctcactctattacccaggctggagtgcaatggcatgatctcggctcactgcaacctccacctcccgggttcaagcaattattgtgcctcagcctactgaatagctgggattatggatgtgagccaccatgcccagctaatttttgtatttttagtaaagacagggtttcaccatgttgtccaggctggtcttgaactcctgatctcaggtgatccacccacctcagcctcccaaggtgctgggattacaggtatgagcccctgcgctcagccttgaggggctgtgttctgtttgggacatgcttaggggcctgtggaactggaaggaggggatgttagcagacagtgagaggaggctgaagtttggggagaggttcaggctaatgttgtagatttggggatgatcagggctgaggtggtagctgtatgaaatggataaatgcagcactgagaagaaaggggaaatgccatgagagaaagaaggaaaagatgaagttaatgaggaaaagagggagagtgtgtcgtgtcagatgccaagagggtaacgagtttcatgaataaggatatgaaccaactgttaaatatggcagagaagtcttaatggaagtggaaaaggccctttggtttggtaaaatacagcagctcatgaggaccccaggaggagttttccattatgggtacaaaagccagattagaggattgtgagacaaaaggggtggagacaatgaatgtagacgattgttttgagaaatctgaatgagtaagggaggagaaaatgtgcagcacagctggagaaggaacaggatcacaggaagttgctttattttcttcttcttcttcttcttctttttttcactcgtaagaataggaggtgactgggtgcactgggtcatgcccgtaatcccagctttttgggaggctaagataggcagattgcttgagcccatgagttcgagaacagcctaggcaacataggaaaaccccatctctacaaaaaataaaaaagttagctgggcatggtggcatgcacctgtagtcccggctactccgggggctgatgtgggaacatcatttgatcctgggaggcagaggttgcagtaaactgtgatcataccactgcactccaggttgggtgacagagtaagatcctgtctcaaaaaataaaaaactaaaaagaataggagactcttagctgggcatggtggttcacactgtagtggtggccacctgggaggctgagatgggagggaaaattttttgaggtcaggaggttgaagctgcagtgagctatgatcacatcactgcaccccaacctaggcgaccgatagatatgtgttttgaaaacataacgctcagagcaggttgaaaccctgtctcttaaaacaataattgaaaaaaaaaaggagacacttaagcaagtttgcaggcagcaggtaaagcactagtggagagggaagttggatccacaggagagggaaaggaaaactgctggaggtaggaggggtaggcctggggtgagataaagggcctggaagagggaagcaaggatgggtgaggtgtagaatccttactcctgaagcccttcactgctgatacttctgctatccttggcatgtgacaattcctcaagctgaggtcaatgccactgtgtcaattgcatagcaattctctttcttggggattcctataaaaactccctcataacaattccccaagtctctagtcttaccttgacgcccctcagtcttacacaattccttgctattttgactagtttgaggttacccatcatgaactccttcgacatctctcctatcttgatttatatactcttcttggtctcattttttcctgcaatattaaaaattctactgatctttcaaggtccaactcaattgatatcccttatctatgtctcactttcatcttacatatacatttttaaattacttgatgtcttttatgttatcttataagctaatttaaatacttcttaaaacaaggaagggattcaatcaacctatcaatcgtcatgataccctttcctatctcatcttcttttcatcttcttcaactttttgactcatttttatatcattcctctatgaaactattaaaccccttaagggcaagtaaatgttttttgcacctgctctagtatgacaatacattatacataatacctacctactacaattaataaattgtaagctcctggaggacaagaatttaggagttagctagctagatagagatgaatacacatgcagagatatatttacattctctcaagtataccaatttaatctaatacttactatatacttgctagcaattagagatatataaagataaataaaacaaaacacagtctctgtcttccaagggtgccaatccagtgtggcaatcagagaatgagagggcttgaatgacatgctgataaaattggactgtattctgctaggtttcttgcagaacttagggcagaggatattaatagatatgtgttttgaaaagataatgctcagagaaggatgaaggatgaatttgaaaagaatgagattgagggtaggcagatctatgagggggcttttgcaatagtgtagatgacagataataaagatcaagtgagggcaagttggttacagatgagatattgagtgtatatgcgtgtatgtgtatgttgggggagtgaggttgtggtgcacaagaataagtgtccagaagttatttgctaatcttactttttaaaagacattaaatggtaaatagtagtaataactatagcttattacatatcgtgtaacacattcctctagactggccttaggcaatattgagatctgttccatttcaccacttaggatcctctaggcccgattttggcactttattctatatgatcggctatttgttcttctcttattacttcaggtctcaagttttgatcatcctatgagcccatatatccttcagagcaagacaatgtgaataggcatcgttgcacttggtagagggttaggcaaatagtggatgccaaataaatccttgtggaattgaatggtattacctggagttccctgaaggttgtacatcctcttactccttggcctttggaacgtccttctctatacctggaattcttcctctctctctttacctcctctgactactgtctctttacctcactttgaccttcctagttctgtttatcacttcctctaagagttgttgcttgatgcccctgcactgggttagcagattttgctaagtggtccacagaatcacctacttatgtgtttctctgccagctctataaagacagaccagactaccttgcggtaatttgttcagtattttatccccaggttgagcacagcacctggcatacagtagacattcagtaaatatttgttaaatgaacatggttttgtggggttttatttgtaaatctgaacattttgaaatttgaatcttcaaatagctggacataaagtgctagatccatccagacgaaagaaataatgggagaccatctagaaaagtattttgttctttatgctattaaattcagtagaaattagttattatattttttgaggactgttatgcaattaacactctggacaacatgaagacagttcagatttcacctttctatcctgccccccaaggacatgcaaaatatctgcttgggtacccgttttttcatgtgtacacactagcatcttcagttgataagttcctgtggggcaggaacagtaaacttctcagaattagaaagcaaaagtgacagcaaaaacacgacaacatcagaaagccagattctatgtcagaaagtcttaggagttgtagctttagtgttctgcagacaacccaatgtcacaggaaatactaattcccttgctctggggcatttattaaaaacaaaattttttgggaggccgaggcgggcggatcacaaggtcaggagattgagaccatcctggctaatatggtgaaaccccatctctactaaaaaatacaaaaaattagccaggcgttgtggcgggtgcctgtagtcccagctactcggtaggctgaggcaggagaatagcgtgaactcgggaggcagggcttgcagtgagccgagatcatgccattgcactccagcctgggcaacaaagtgagactctgtctcaaaaaaaaaaaaaaaaaaaaactaaaactaaaacaaaattttacttcctactgcctggtaccatattatgcagtagagacagaggggttaaggaaatcaggcatagtccttgttctcatgtagtttgtagttaaggagtgagagaactggcagtgacctgattttgaagaggctgattcaggtcaagacccaattttgaagctggtctccaacaagaagagtggtttctaggaatatagctctgcacaagcaaatacatatcccttagacagtctgtgacatggagtgaaaaaccctccctgacagatcctttactagggatctctgcaagggctcagatctctacttcaatagaaatgctcattggtactatctgaggacgatttttccaagaggcacaaggagatcaattactactggcagcctaatttgcaagataaagaaatttcccattattctagtatcttcgcaaccacagtctacttcagcatcatcagccgacatcatggcatagtggaaaaaaatttggaatagctaaaaagtcacagattagaagttctcatagctgagatgctgctatgtgcttcttgttaaaatccagggttaggacaagggtcagaggattcttgtccttctacacttgagtggcctacagccatgtattcttctaaatcatgttttgaatttcgtcttgaaagataatgttttaagagtgctaagcttatatactcatacaacagaaataatatgtgtgataaagttgggcaagaagtgcttttaaagttgtcggtttctaaaggtgtctttttttaaatgggtacttaatagttatacctatttatgggatatatgtgatatcttgatacaagcatacaaagtgtaatgatcaaatcagtatccatcatctcaagcatttatcatttctttgtgtaaggaacactccaattctactcttttcatcattttggaatacacaagaaattgttaatcatagttgccttattgtgcttcaaaaaagttgtcttttaggttgtcttaaaatttggttacgaattgataacactagtcagaatcatgatttatattctgtagatcatttttttccatttagctttcagttataatacctcacagaataataaagcttgataggttaagtgtcttggtcctgactatcttgagaataatggttggagcaagaactatggtccagacgtctgctctagctgcaatgtttcccctccctactccattacaccacaatgatggatgaatgacggatgctgcagcagaagtaattacagtaaactcaagatataaaaacaattaatatagtgaaaatatataaattaataataaatataaaatacatgcatctttaatattaagatgtaatataatttataaattaatatagcaaatacagtaatatctaatggacagtgaccccatcaccccacttttacacgtgcctctaagagccatttcttatttttgaaggggagcagctacaccctcactctttgggttgcggtgccgtgtagaagtgatgagaatgggaaactgatacactcctgcacagagaagccaatctgaatgccagatgattaagtagaaacctccaccatgctgcctcagacttacaaatgaagtgcaaattaaaatgttagatagacatactcaacagcctgtaacatcacaaggactgtctttggggtatccatttctataaaaagaaaatctggcattcctttttggaacattaggccaaagtagaggataatgagaacagaaatgccttatgcagtcttaataatctttctactcagaggattcagtggaaactagtaactaaaaaagattagccttgcatcaagaccgagctatccagaaatcgcccggcctgggatgcagattcagtcacttaagtgagttgtaacacaggctcacttgtaggtttgccacaattttcttgcaattcagttccttcctctgtcaggctgcaataatgagatgaattcctgcaagaagtactcccagaaagacacagggaggtctgagtagataactaacacagatatctagagaacagaagtgctagacgaagagagaaataaacacacacaataattaaaacaaagatttttttaaaccatagcgacattacacttatctcaatctttaaaatccaggatatctatatctttgtgtatttctcactgaaactttccctgggcctcccaggaagaacataaagaataaagaataggttcattttcttacagattaagagatgtgaggctcaaatgaccttatcctggtaacatagctacattactgcaagagcagcatctttaatccctatgattcctactccagtcactctttaccagtgaaccatcaaagtaggtgatgatgctgaaagaggtacagaagattcagcttgtgaagataagccgaatgacagaaaatgcactttgtgcaaacctccatgcagtgatcacaatgcattttagccagtggttcagttctctctctgtccaactagactatgtaccttgaggatagaaaccatctgtccacctaatgtccccagtagtcagcacagtaactaacacatagtagtcaattaatatttgaagaacgtataaatgaatgaatgaaagcatgaatggatctggaaaagttgccatcaggaattggggccctgaagaaagaatggggttcataaataacattcagcaatcatagtcactgaattgggtactaatattagtgaaaataatagagacagtaaaaccaattataaatagataaagaaggtagtgcttgttctgttttgtttcataaaagattgacaattttatttatgaacacaggatttgagctaaaaagagaacagataagaaggtaggtgactaaagaaatggttgccgagaaaaagtatgaaacagagtttagaacagagaagaggatacagagataattgtaaaggtgtttgacagaaaaagggaaaaggagaaaagaaaaagctttcagtaggacactttatgggcataatagggttcttctttagggcatttcggaagttgagagagcaaagatgagaactcgagagacatggaatggacaaaagagaaagggaggtgagatacatggtactgatcactcacagggaatgaggaagggaagtaaatggcctcaaagaagtcatagctgtcatcgagcagcaaatgccttctgtcatgcaggtggaattaaagcttaaatgtgaactgatggtccatcttcagcttctttctcttctcgctctgatacctgccctcaaggttgctccctggctggtcagggaactcacactgagctgtagaatgttcccaggctctggacctttctgtactgttattcaaccatcagcacttgctagcttctgtcctattctctcaggatgcctgtttttattaaatgacaaaggaagttaattggttcatcaagtagagcaattcctattgtgggcttagctggctactagttaccttgcctattacatataacagcagtgaaataaacataaaggaatgaatgggtgggctttcattacgtgccaggccctgagctagatgcagcagagtatggcagaacaggacatgggctttggagacagacacacccaagacagaggtctggtccataatttcctagctataagcttgaggaagttatctcctagggttcttggattcttcatctgtaagatatgaagaataatttcttcaccctcaatttcctcctctatgaaatggagataatgttgcctacttcgcagggttcaaaatacatataagtgataataatgttatttactatttattcatttatccccactttaaaaaggaaaagctgaggcacagagaagtaaggtgtgactaaggtcacctagctgggaaattctagagctggcatttaaatctagcatttgtctttatgcacttacccaacatactatgtcatcttaaccaatacactaaagcatcattagatgtttccatctacagcctcttacagtggggaaacagtttgatattcaccaatctcatttaaccctcacagcacctctgtgcagtactaacatcttgctttaagatgaggaaaggaaagctcagagaaggtaaccgtggccaaaactcaacataggcccagagaagggaacaccagccaaaactcaaagagctaattagtgacagaacttgaaattagatgtagggtttatgaccacaaatataaatataagaaagagagccaactctgggcccagagtagatgcccacatctttactagttatctaggtggtatttctacattgcttttaaagttctctgatagcaaagctgaaacctggctaggtgttgtaagatagatgagaaactgcaagtcaaggtgtgagttcaatgagtggattttaactcctaacttcaggagtactggtcaattatcctttactgagtggtgctatcagcccacggtaaaataaattagatttttaagaaggtgcagaattgccactataaaatcagataagcctactgcagttgggaataaattctatcatagaaatacatcttgcctgatatcaaaggaagccaagaaaccatgccaagagttggatgaaaactgacattttctgctgtggagacagaagtggtagcactgattggagaattatattttgaagagttctaaaatatttatcatcattctaggtcatttattcatttacccttttaatgctcatttcttttgtgccactaggtcgagcttaaaagcaaagaatgaaaattcactgtgtttttatatattaatatgaagcaggaagtttctctattgcttggtttgaaaaataaaagcgtttctgagaaatattagaacactaaatgttctttcagaaacatggcttttgtcattaataaggatgctgggtgtatctaagcgtgttatgaatttgtacttttttttgtttgataacttcctgtaacttgaagtatttcaagaagggaaaaagctgataaaaactactaaaattgccattgcttcactgtattgattgccccattatgtttctttctagacttgactcaggcatctccttctccaggatgccttttctgctctccattctaattaagatggccttcctctgtgctccaggagcatttacacaaaccactatccatcactgcccttatcacactgcatcgaagctatctgcccgcacatctgtgccccctggaaggcaatcaggacaataaccatggcttatattccacctggtgtcctcagcacctggcatggagccagaactcagcaaatttttaccaaagaacaatgaattttaaaacctgactatagaatggcagaatgctccttctgcctccacgaaatttactttcaagttgaacaattttattaaaaattccattttctaatggtatcagagacctgcaaagctaaagaaaaagcaagtcttatttccaggtcagaacttatttcccaggtcctcactatttggcttatataatattaaaaggtatttttaagagtataatttctatttctcaggcttgaaggatacttttgttagtgtcctcatagctttctattttggctttgcatccagagaaatgaaagaggcttgactcagctgccgcttaatactgcacaagcctgagagagaagactattatataagctaatgtgtattttaaggtgtttttttttttcatagccaatacctaaatgccaccttccaacctcatgaaagtgctgaaccccagtgtgtgggaaagcgaggtcccctacacggctctgtattccttataagtataaaaaataaaagcagttgattaagggttagcaattttcttttctttctttacacgtacttgtaattcatttaatgcaggaagtgggctgagttttcttgttctttccaattcaactctcagggagctttcttgccagcctgctatggttaccatggcaacaaggcgatggtggcagtaatatgatctcatatgccttgtgtcaatagcatcagatcatcacgcttgaggataattttgacaataagcttcagatatagattcaggatatattaccatttgattgatttaccagaaatactgagcaattacagccttaaacttctaataaaagcatgttcacaaaggttagcgtttttccctagatgacatattatatggcattctgaaatttgtaaattgctttcatatatctgcttcaattctcattaggcaggacagatataatcatccccattttatagaagaggaagtaaaggcccgtgcaatgtgctgtgtaaggtggcaaaagcaactccacagtgaagctgaaacttcaacttgaggcttctggcatcagaatcacactttcctcatgcctgtgttaagaattcatgggtattatcaaaatgttcttagatgcataggttagaccctggaatgtctgaattaaaataatgtaaatgtatctgtgataaataactactagtttgagaatattagtattttatatttgggtgatgcttcatacattttatatctcccattacaccttcctttcctaaggcttttctgatactagatgcacaaatagatgcttatctctttctcccactgatcaacatcttgtcttttttgttgttgttgttattagtgacatttatttttccattgtgagttccttgaaagtagggatcatgttattcattcttggaaggtccctgatcctggcacagtatgtatggatctgttatgtatcaggtactgtacataatatgtaccaggtacataacagatacaccataaatgcttgttgcttgttaaactgaactcatctgacacccacaaaccccatgaggtaagtacagctggcattatgatccactattttaataaagtggaaatagaggtcatggatatatcatgggcaatttaattctttccactcccagccatgtgctctttccatgtcgtcctgtttgctttattctttcattgtttctctttcattcattaattcatcaaacatttattagttgctctttctatatcaagcattgctacagataatgggttacaaagataaataagacacaatcctcagcaccaaagggctcacagataatgcagataattttctgcctaggcaagtagtaaaataaaaccttatatggaacttcgagtatgcattatattatttcccaactttattggctctttaaaatgtatcttgagaatatgtttcaagtccctctttaatgcagtgttttagaactggataagccttgagccattgccaatatagggtgatactaattctgcatcttcgttttttttcttgggcataaaatcagcatttccaacatcccacagaatccctaaacttaacgtgtcctcaatgaaactcagtatctgacctgaacgaatgggaagtggcagaaagaggcagatggtcagggtgagatgccagactctgccgtttgatatgacttagggtcagttacaccatctaggggtttcttcattagtatctggcacgaaacacagtgttcaaaatacttcttaaatgtattaattaatgaatgagttgtcaaagaggatgaaaaatgatgacataaaatagggatacctgaagcagtgttagcattagcaggtactcaataaacatcttttaaagagtggactaaatatatacgattcaattccccttcctgaaacatattaaattgccaagacaaaacttctaagttatctttatgtctctttccacatcatagagtcaggtttatttcacctctgcaatgtcttggacttgtgcctttctcttcatccaatagcatgatttgatccaacccccaccctttcactagtagactctcagagaaggcccttgactgaacttcctctctttccagggtctcccattccaccttactggtgaaactcttatttttaaaggataactaggagtgtataactcttctggccagagattttgtattgatttgtatattctaattaagaaactttttagaatggtaatcaagatcctctaaaaggtgatctttagttatacctatagtcattcctttccatatactctaggttttagcttcccctacacacacttttggacttttaagctttcttcctgtattcctagttagtggagtaataacagctttgtaatacttttgcacaacactttgcaatttgtaaggaactcatatatgtttataatgaaactttgtgataacctcagagtaggtggatatgatcattttcatttcaccaattaggaaattgaaaatcagagagttaaatcatacagattctcataacctttatgagaattctattggaaaatatttgtgtctatgatgattgtttaaccatggaatacttgaatcaaactctttaaattaacaactgtgacttcaaaatgctaacgattgacatttgttcagctcgttagcccagaggctaatcatgatgcttttcttctgcatagcaaaagaaactatcaacagagtaaatagacaactacagaatggaagaaaatatttgcaaactatgcatctgacagaagtctaatatacagcatctataaagaatttaaacagggtgggcatggtggctcatgcctgtaatctgagcactttgggaggcggaggctggtgcatcacttgaggtcagaagtttgagaccagcttggccaacatattgaagccccatctctactaaaaatacaaaaattagctgggcgtggtggcatgggcctgcaatcccagctactcaggaggctgaggcagaagaattgcttgaacctgggagatggaggttgcagtgagccgagaccgtaccactgtactccagccttggtgacagagcgagactctgtctcaaaaaaaaaaagaacttaaattcacaagaaataaacaaataactccattaaaaagtggcaaaggatataaaccgatacttttctaaagaagacatacatggagccaagaatcatatgaaaaaaagctcattatcactgatcattagagaaaatgcaaatcaaaaccacaataagataccatctcacaccaatcaaaatggctattattaaaaagtaaaaaaataacagacgctggtgaggttgcagagaaaaggcagcacttacacacgatgggatcataaatttgttcaaccattgtggaaagcagtacggtaattccttaaagagctaaaagcagaactaccatttgactcagcaatcctgttactgggtatatacccagaggaatataaatcatcctcccataaagacacatgcatgcgatgtttactgcagcagtattcacaatagcaaaaacagaatcaacttaaatgcccatcaatgacagatggaatgaagaaaatgtggtaaatttacaccatggaataccatgcagccacaaaaaagaacaagatcatgtcttttgtgggaacatgatggagctggaggccattatccttagcaaactaatgcaggaacagaaaaccaaataccacatgttctcatttgtaagtgggagctaaattatgagaactcatgaacacaaagaagagaataacagatacttgggcctccttgagggtgatggttgggagaagggagaagagcagaaaaaataactattgggtactaggcttagtacctgggtgacaaaataatctgtacaacaaaccctcgtgacactagtttacctatgtaacaaacctgcatatgtaccccacaacctaaaataaaagttaaaaaaaaaatgatgttcttggctgggtgcagtggctcacacctgtaatcccagcactttgggaggctgaggtgggtggatcacttgaggtgaggagtttgagaccagcctgactaacatggtgaaactctgtctctacttaaaaaatacaaaattagccagctgtggtggcgcatgcctgtaatcccagctacttgggaggctgaggcaggagaatcacttgaacccaggaggcagaggttgcagtgagccgagattgcaccattgcactccagcctaggcaacaagagcgagactccgtctcaaaaaaaaaaaaaaaaaaaaaagatgctcttaagctggattgcctgtgtggaatcctggctctactatttcctagctgtgtggtcttggatagattacttaatctctctgtccttcaatttcctcatcattaaactggggataccaatagtttctattgtgtaggattgctgcaaggattagtgaattttatgtgcgtaaagtgctaggataatatctgacacatagcaagcactcctaaatgttgctacccttaaagacacaacctaagaacttctttggctagtccctggtctgagaaggaaaatcaattccttcctcattggtgctaccttgtttgggtcttctatactggggacactatagctgcctcagggtgttggctcaggatagattcagaatatctgaatctacttattgggagcagtcactgagtttctctaagcctcattcaccatctgaaaacacctggataataacagcattttacatcataggattgtggtgatcattttattaactagtacatataaggcatctagtgcttggcatggagtaactaatcagtaaaatttagtgactattactgttacataaatgttttgcccatgatattttgaccttcttgggttaggacctgtctttttcgttatctttatgcctatctttgttgcttcttcacagtagatttaaaaaaaataaacatttaaataaaaaagattttgcttatgagtgtcttggctatatgggctcttttttttgttccatatgaaatttaaagtagtttttttctaattctgtgaagaaagtcaatagtagcttaatggggatagcattgaatccataaattactttgagccatatagtcattttcactatattgattcttcctctccatgaacatggaatgcttttccatttgtttgtgtcctctctgatttccttgagcagtggtttgtagttctccttgaagaggtccttcacatcccttgtaacttatattcctagatattttattctgtttgtagcaattgtgaatgggagttcactcatgatttggctctctgtttgtctattattggtgtataggaatgcttgtgatatttgcacattgattttgtatcctgagactttgctgaagttgcttatcagtgtaaagagattttgggctgagatgatggggttttctaaatatataatcatgtcatctgcaaacagacagtttgacttcctctcttcctatctgaatacgctttatttctttgtcttgcctgattgccctggccagaacttccaacactatgttgaataggagtggtgagagagggcatccttgtcttgtgcccattttctaagggaatgcttccagtttttgcccattcagtatgatatgggctgtgggtttgtcataaatagctcttattattttgagataagttccatcaatacctagcttattgagtttttagcatgaagggctgttgaattttgttgaaggccttttctgtacctactgagataatcatatggtttttgtcattggttctgtttatgtgatggattatgtttattgatttgtgtatgttgaaccaaccttgcatcctagggaggaagctgatttgattgtggtggataagctttttgatgtgctgctggattcagtttgcctgtattttattgaggattttagcctcgatattcatcaggaatattggcctgaaattttattttcttgttgggtctctgccagattttggtatcaggatgaggctggcctcataaaatgagttagggaggagtccctctttttctattgtttgaaatagtttcagaaggaatggtaccagcttctctttgcacatctggtagaattcggctgtgaatctgtctggtcctgggcttgtgttggttgctaggctattaattactgcctcaatttcagaaattgttattggtctattcagggattcaacttcttcctggtttagtcttgggagggtttatgtgtccagggatttatccatttcttctagattttctagtttatatgcatagaggtatttatagcattttctgatggtagcttgtatttctgtgggatcagtggtgatatcccctttatcatttatttaaatacaaaagatttttcaataaaaatgattaaagtagcaggatagaacaatctttgcagagaaaatcccaaactctaagtggatggatgctgagactgtatgcaaaaacgctaaattctagaaagagttaaatttgaaaatatctattcttattacaaaatattgatctagtggttgttgggaaaatataaatgtaccatataataaattgggtttggattattaaaattctattaccttgtccacaatggaagcaagaatataaatgactttataaaactaaaaagttttaaattttcttctgtacattggcatatctcacaaaggaatggaattggttacactgcatatgagaacattttgatgcagtataatcttttattgtgcagctttatatagcaccctttcctgaaagagtgactgtacagcgcctggtgttctaaatccagtcgctaactcaaaccttttcactttcataaagaggttttgggaatgaagttaatattccatttaccaaactaaaatataatattatgtgctgcaatgctgtgagcccacccacccaccagactgcagataatcttctattcatatgctcaaatcaagtactatgcatatttctagctcactatcaaaagtaactgcacatatacacaaagaaaggatagaagaaaatgaatgagcagtcaaaaatgactgcaggcgactttaacaatacaagatcagccatttttgacaaatatttgatttgaaattcactgatcttctattaggactcaagggctggcaggagtaacgaatttcctgagcttctcttatgtatgttcagaagtattggatcagtttttggtctcggggtaacaacaatagcagcaaaacagtaacagcaaccaacatgcactgagtttacttcacaccagcactcaggcagaacttctgcttcagcagggtgaataagagcccccaaaggtatcagatcctaatccctggaacctgtaaattatgccttattaggagacaggaacttgcagttgtgattaacttaaggatcctgagatggggagattaccatggattatctggatgggccctaaatacaaacacatgtatcttataaaatagatggaaagggagctttgacagacaaaagaggaggaggcattgtgaccacagaggcagaaattggagtgatgtgggcacaaatcagggtatgctgacagccgccagatgctagaagaggtaaggaacatattaccctctagagcttctggagggaatgagcccctgctgacaccttgattttgcccaagtgatacttattttgaattcctgttctccaaaacttggagagaagataaatgttttttttagccagcaagttcatggtaatttgttacagcagccatgggaaactaaattaagcatccaaccattgaactaatatactaatatattgctgaactttggttcattccttcataagcctcccaaattcttgatttctttgttctgtgggggctgctgctggtaagagtagagctattaaagcatccttccatgtgaagcatcacctgctgacatttttgcagaatcccttccattgtcagccctacctacttacaagttgaaattgacacacaggtgcagtgagtcaaggtctgacttgaatgctttgcttttctctcagtagattttcttaaattcagcaagtcctcacttaatgtcatggataagatcttggagattgcaactgtaattgaaactatgtataaagaaaccaatttgaccacagtcaaatcaatataaacaagagttcagttcctatggtatatttctggtcaaagaaagtaatcaccaaacttctaaataaagaagcaaatacttctaatattaaacatcaaaataaatgggagctatacatacatttaagaaatattaatgaaaaggaagatgatgatttacccaattattccagttcaaggtcgcctgtcccggcaactcagggcaccaggtgggaacgcaccctggacgggacaccctcccatcgcagggcatactcacacccacattcgcactcactcagactgggaccatgtagacttgccaattcacctagcattaagcacatccttgggccgtggaaggaaaccggagtgcctggagaaaacccatgcagtcatggggagaacaagcaaactccacgcagacagtgacccgggctgggagtcaattttttttcttatcaacatcataaggaaacagcattacaggaaatggtgtaacttgaggacttgctctatagaactacacatgccattatttcagtatgtttcttttcttgtttgatctcattcatttgcacacttgaatccaccaataattaaaaacatctgtgaatataatcaatacataagtaatgaatttattgtttctttgggccagaaaactgttaagaacttgttatatgcaaggcattggtttagaaaccagatattcaatgataaattcttgacctcacttaaattcttattgagatgaaaagaaatattatcaagtcacaaacagtacaaagctgggtgtgaaaatgccataaggagaagatggagacaacgctgacattcagatttctggcttaaatgactgaaaaaatagtgatgccatttactgacatgggaactgcaggagaagcagcagatttgggaagagcagtggatttgaggtccctggggggcatccacgtggaaaaacaggcctgatgttaaggagagagaacttagaggttttgaaattatctgggcattggtgataattaaaatcctaggaatggaactcattgctcctggacattgcataatgggagaagaaaagagaggcttagaaaaagtacagggctagtaaagcgtatcgcatattaagagaatgatgactaacctaatttgagatttaaagggatctgataggagataaattaaaaatcagttgggtctatccaaagaggataaccctatatgccagcctccaaaatttagactttttttttttttggtcatatgtattgagtcatagttagaggttttaatttggggactagtaggattatagctatgcttataaggtaaatccagggtagtgtgtaggatggacattagagagaaaagacagaggctgaagagttgagttggaatgttaatgtgatgatctagaattagaggtaatgaaggcctgaagaactgttttaacagtgtgtgtatgtaggtatgtgtgtgtgtgtgtgtgtgtgtgtgtgtgtgtgtgtattttccccccaaatatactaaataaaattggtatcaacatttcttatcaacactatagggaaacagcattaaaggaaattatgttacttaaggtacttgaggtttgatgttcactcaaacacttttgagtatttatttctgcattaaaggtcttgcatttcatacatacaggtgaaaaaagaggaaggcaagatgtcaagagaaaaaaatgtggcatatggcctgacccagtttatttgttgagaactttgtggaagcaggatcagtaggatgcgctgcgatgtatcctggcagtggagaggaaagttaataataaccatagccacgggatgaacagtggctgctcactgagtgttgctaagggccatcaagaggtgaatgaaaagaattatccttttgttcccttcatggagatgctggcaaatgaactgaatttaactcaatgaaccacaaagcctaagggtaactgttttcctttgtggtttgcttattgaaagtcactgctgagctgatacgggtgttggggacaatgtctttgaccttggagttcttaaaaccatcctcagactcaatgaacagttggtaaggttttaggaatgtcctagcaaaagcactctggattctgcaggcaagtgggataattcctgaagtattattttaaaaattgtgtgaaacagtggaaatacactatttggagtcagatagatgagggtttgagtgccatttctatcacttggtgatcctgagaaaatcagtctccttaagccttaggcaaaatggggataatgatcgattttgtgaaaatgttaataaaataatatatggaaaaataatatatttgaatttatagatgagacttaatagataaatgtgactgccctcccatacttaaggtcactaaaaatattaattaagagtatgttgaatagaagaatttggaaaagaaaatcaagctagagagaatgggagaaatttccttaagaaacaaaacataaaattttattaggactatttgatttgcttaactgaaactctatcaaaagccattttctggtttttacatgaatcttcaaatatttctaatcagcagtttttctcttaactgccactcagcttttggttggatgatgcagagatgtaggtgtttcgagtaactaatacaattcccttctagggtatgttgcagggtgccttaacttactgtgtatgcaaggtaaataactcctaatatgagacaacaaacaaaatacatgtctaatcaattcagaaaaatgtttaggaagctccataaacatgttttcataaacgcttgctggcagccaacttgcctggctttcagagttgctataacaaccagcagtcctctcagcagccttggcactctgcattcttacatcttttaataagaaatatcattatcttgtctgggctcattagctcaattatttaaagcatggtactagtaaagccaaggtagagggttcaaaagtatgcattagcaagaaaattctatccatgtgtcctttgccaaggcgacttgttcattcattcattcatttaaaaatatttattgaatgtctgccatgtgccaggttctgttctaggagctagaaataaatcagtaaaattaaaaaaaaaatatatatatatatataaacatgtatataaaccaacaaaacaacaacaacaaaaaaccaacaaaaaaaccccaaaaaaacaaaaataattaagatgccagttttagtgatgtctatagtctggtttgaggggcaagaagggagacagatgctgactaagcaacaaattaatatacatgtagaaatacatgtagagtgagaacaatgaagacaaagcagggaaaggagacaggtgctgtgttagggtgaggagaaagtgcctcttgatatggtgacattagagcagagatttcgatgaattgaataagaaaagctgtagctaagtcatggaagaacgttttaaacagaaggttagcagggcacaagctctgaggtgagagtgtgcttggccggatcaggaccagccaggagacctgtatgactggggtattagtcagggttctctaaagggacagaactaagtggatagatgaatatatgaaggggagtttattaaggagtattgactcacaagatcataaggtgaagtcccacaataggccacctgcaagctgaggagccaggaaaccagtccaagtccccaaacctcaaaagtaggaaggtagatagtgcagctttcagtctgtggcctaaggcccgagagcccctggcaaatcactggtataagtgcaagagtccaaaagccgacgaatctggagtctgatgtatgagggcaggaagcatagtacaggagaaagatggaggccagaagactcagccagtctagtcctttcacgttcccctgcctgcttttatcccagccacactggaagttgattagatggtgcccacccagattgagggtgggtctgcctctcccaacccactgactttggcaacaccctcacaaacacacccaggaacaatacattgcatccttcaacccaatgaagttgacactcaattgtaaccatcacaattggagtggagtgctcaagggaagaacagaaggtgatgaaatcagacaggaagagatgatctgtccatgcagggtcttggaaaccactgtaagggattttagattttattctgagtgagacaggaaacgaatgcagagttctgagtaaaggggtaatataatctgacatctactttaggaaaaattgctttggatccagagactctacgtaggggctcaagaaggaaaggggatctgttaggaggttattgcaattaaacagaggagaggtgatgacagcttagagcaggtgccaaggatttaagaaataatcagactctggatgtttttagaggtagtgccagtgggatttgctgatgaaataaatgtgaagtttttctcttgagcactagaaaaatgaagacagcatttccgccctggggaagactgaaaaataaaagcatgcacaaacttatttgtgtgcatgtgtgtgtgtgtgtgtatgtgtgtaaggcagaatggagttgtggatgccttaatgttgagatttctgtgagacatctaagtggatactttcatctaggcaactaaatgtaaataataaaatctctttatagatttcagagttcaggagagatgtctgggctaaagatacaactgtaagagtcatcagtttatagatgtaatgtaagccacgggtctgaataaggacacctaggaagtaaaaatgatagagaatagaacacaaagaactgagcctttgggtaatacaatgttagacttgggaaagataggggaggggcatccaaaaggagagaatgagaaggaatggcctgcaagatggaaaaaccaagagataatgggggtattggaagaaaattaattcaatatgaaggaatttatcagttaagtcaaatgctgatgataggtcatataaaatgagggctgagaattgacaaattcggcaatgggaaagtcactgatgactgtagttagatcacttttagtagggtggaaaagagaaaaatttcctgttaaagagagaatagaggtgaagatggtgattacaagatcttttgggaggttttgctataaagtgagctgaaaaattggacagtaactgggggtaatgtagggtaaacagaattttaaaaattcaaatgaggacttattgtgacatgtttgcatgctgatgaggataatcgacagagaggggaaaattgatgatgtgcgtgagagcaggggtagtgaagcctttgagtagacaagaggggccacatagtttaaatgtgggaaatttcattcattcattccaaaaagttaagcaaacatctaccatgtgccaaatacacagctaagtactaggaacacagaaatgaataaaacatggttcccattatcaaagaagtcatttctttgggagggagaataagcattttctctaattaataattcacgttcaatgcagtgatggtaatgtcagagaaatgtacccagggctcttttctgggatcttttcattacagcatgctgaatcttgggctgccatgtcattagaagcctagattcaagaccttcatttccatcatgcattgacatgttctgggctgtactactgatgagactgatttaggcaagagttctgggcatgaattggtgctgtggctgcacagataaagtcgaggtgatagatttgagaactgtgtgctaggtaaatcagcaatcctggtgattggttgacttgaagtaaggtaaagaagagggaggctcaaggataactcctaggtttcccatatttagttttatcctggaagcgaggatgctgataaacagattcctaacaggtagcgtgggtggataagaagaagaatctgggcccttttcttaaaaaaaattaaggtctgataaatacctgatactttcaaaaatatttgaaagcagccagatatttctgtctataaaaagaaaaaaaaaatagacctgatctctataggatgtcacaaacgctcaaaaaataaaagataggaaagactaataatacaatgctagaacactttttgatactacctaagagacttaagaaaaaaaacaccaaacccccaaaacacagagttcttggtatgatgtatttgtttttccatagaatggtttgagaaattcagtgaaaattaattggaacatgtggttgtcattcacatggttccagactttatgggcttaataaaaacattatgaatagtttttggagttttgggagaagcgaacatggctggtctaggtatctgcttttaggttaatccctctacgcaggaagtttcacagtgtcatacagtgcttttcaatttttcccactcaaatgctcccactatcagagggatgagaatgagcttccctggatggcagaggaagaaagggggtagggtagtctgagggtgtaacttgaagtttcaagttgcaaacataaagtttcctttaagtctagtatttcaatttaacagtttagcaaattttctgtgcaattccgtaaaatattcatttctttcatatagaaataatagagtctccccctccccccaccttaccctgctctgaatcactgagtaaaacctatgcatggcgaagatatgtcatgttttatctcatgactttgattgcatccttgtatcctgtcacaaagcaggggaaggggaaagacacagaaccaagtttcaggaggcctggactcttctacgccagttcgacatttattttttaattttctttgcactctacttatttccaagaggagttttggagttgctgtaagacttttagaaaatataaatgatctgtgccttgatttccttatttctaaaaacaaagaagttactctacatgatctctatattcccttcttatcgattaagagtctacccacttttggtccaagcaaaatgttaacagggctagtggatggtggtaccaaatgtatactggtaaccgatcaattaacattttggaaaaaatggaatattcagctaagatttgagtcatgatggaaaccttgaatttaaaaaaaactaaccttgggagattattagaacttagaatccacatatttgacatgtgctgtaaaaagaggttatttcttgagaagtagaattgcaactttctgctgaaaaaatatcaatcctccaaggcatcctcagtaagcccacaggcaaactcccacctcagcagactgaataatttgcctataaaatatcacgttgaatttgggaggctgaatatggtgggaaaagtttcatgtaggagaggacctgccctggagatgctcgctgaggtggcaaaggcaactggactctcaaagtagtcctccgtttaacaacatccctttctcaggtacttctctcatctgcccgattacttttttttttaaagcctgacaggaatgatgcttccagattctgagatggtaacaatgatctaaatagactgtcatcatttatcagcattcacaaagagaaaacagctatgaatttccagtgggaaaaaaaactttagaatcaaaaaagcaaaaggtacataatgctgtatccagtgaaaacttataaaagtgtaatgttcgctttaaacacaatacaccaccctgagagggttgccttcagtaaggaattgttttcctctgggaaggaaatcactggcaataccaaatctataaggagtgccttagaaacttggctgcaccaagggccgtgtagttttgggaaaactcagcctgttttctttgtctctagacattttttagacttgataatccctcacatgggtgttggggtgtcttcaaggtctccaactctgtgctgtacttcgatcagcaaatgcttggggagaatttctgttttgattgcatctgccatttgcctccacaaattagacttttttaaataaaatgtaatccttttttgctgagacaaggatgaacacaatttattttgaaaagatacataaaatgtattataaaagacacaatgtgcaaaccagaaattgaaaactaaaaacgaacatcacctacacagaaaattctaagttcttaaaccagttggttgaacgaccttgggcaagttgtttaacttctttgaatcaatttcttctttatctgtaaaataaatacttataatcgtttcaagaaagtttattgactagaatccctggagccattcaaacagattcatattagccctcagcgtggctaatggcttcatctcaattctaagtgcggcacatactttcttgaaagtattgttaagtatttattttatagatgaaaactggttaaaaactacacagtagctgcatactgtaatggattctgaaaaggcctagttcaaactctgaccttctataaataacattgtggcctgccatatgaaaagacagtattgctagtgtcctgttgctgcatgggtgatgaaattaggacacggaccatgaatgagttgcctgattctgaatcagactatcaggcagtacagaaggatgccttcctctaagagttcattatttcctattagaatgctgtgtgtgctgcacatagaattgaggtggagcccttagccacactgatggctaatttgaacctgtttgaatggctccagggattccagccaataaacagaaacttgtctgttcatctgtacattcctctcaaattggttgaaataaatcctcaacacttgatgtttctgacctggttcacagatactcaggagcagcctgtggtatagcattatgagaaattttccagtctgttgagtagaagtaatccaatcctgtcactgtttgtggtagaaaggagagagaatatagagatgagatccaagaaaacaagaaaagttctgaggcctagaagaagtggaattctgtggcaaaaagtctggagaaactgaatttgagtttatggaaaaagccaaaagacagaacatcctggagaatagagccactctttgactggaagcttggaggatgattgtgagtagaatggcctatgtctaattctacatgcaggaggatggagcaggtggggccgtttcagggccaggaaagggtctcccttctactggactgggatgaaacaagagccaaggaacaaattgagttgcagtagcagatagaggaggtccagtctgagggtaaagcatggtgtccaagtagcattcagcaatggcagagcataaagtagatagttccaactggtagcccaagataaagaagcattcaaatgtatgcctgtggatggtgttcccttcccacaaggcacagaggattctgggtcaggcatcactcagagttccagagggaagggtatacatctgtcaatgcatagcaggtctcagttattcagcccaaagcaaaccattggctaaaacctttgataaaaagaaatgtgacatgtagcatggagggtggggcaagactgaggctcaggaatgggacagggcctgtcagaattaccagaagtgaggcagcaccacaagactagatcagcagcaagagttatttgaggtgcagtcacaaaaggtgagttagaatttaaatacatgccactttgggtctgatttggtcttaagtgtgtaggccaaggctcagtcttgaggtagagcatgatctcatttgtggtaagttgagagtatgctgaaattcagcatgaaaatggagatcagagatcctccaccttgctgtcagtctagacagagactgaaaaactgggttaaaactttaaagtctttatatcttggatatggagataaacaaggtaatactgcctggataaataggggaagaagctatcaaaatggtattgatctttccatttaagactatctattaccattcatctcttcaacatttgaaaagatgttcagtataacattgggattttaagtgatgattgtatcaaaaaatgataagtttaaaacattttaaacttatcagtgcacaagaacgggatgaatgcttatccagtatttctttctgtatttattatttgagtaaatcatgagtaataggttggtcccttatttaaaattttagttatggtcaattttaagaggaacacaataatctttttttttgtcttctgtacagttatatcaattttagcagtttggtgtctagttttaccaatgctattttatgatctttgccatttgccatggtacaatgtgtttaaatggcacatcaaggtatactgatggttgccatttgcttaataacttaaaagtaatccagcaatttcttccacttttatttcttaacatatgattttgttttgtgaaacatgaaagatgagtcttatatttaggaaccatttggttgggaagctgggagagtaaaatttaattgattttttttcttctgcagctcttgaagaaatagcatgtgaatccagattaggtggcatcatgtatatttttgtaaaaggaatttttacttgcttaggctgaattcatccttataagcctccctcagccatccttaattcctccctttctctcactcctgaagtcaaggattactatgttttattcctttttctgctgcaatatcccggactcttctctgtccatcactatagccacatcagctaataagctcctcttcctgtgtccttcttccctctctactcatcctctatagtgccatcaaagtcagagtattaataaacaaatcctgacatgtcagtgtgcttactccccacattttgaacggattaagttcaaatgcctcacaggatggcatttgaggtgctgatcctaatttatctttctaaccttgtttcttgcctctttcttccattcctcacatgcaaacactgaactccagtaacaccactttgtcttctcaacatactctgcactattgtgtcttcatgccccttggtacatgctatttcctctgcccagatattcttcctgggcttctgtacctgttgaccccttcaactcatcctttaaggactggttcaaagaccacttctgtgacatcatccctgattcccacagagttaaacaagacttctatgacacgccacagcatctgaaatacatctgtgctggaaacttctactatattgccttgtaatgatttgttagtgaacctctctcttccacttggtctgtagctccagaaaaccagtggctgtttgttgcctactcgtctttgctttattcttccttctgcctgtccacctgctctcccaacatccaggggccaggacagtccctggcacacaatgaacacccaacaaacacttggtttaagcaatgaattattatcttgcacgagatttcatgagtctctttagttttgctttcttaacttacttaatgcttattaagatgacttttcactttcagttcttcctgtttgattccagttcttagtcatgtcttccccttggcacaaaactgattgagcaatatatgctgaagcctcactcttcaaatttcatgacaaagtctgagggtcccaggactttggccaagcacaaatagtaagtgtctgggaggcatcaactaaattatctgccagtgaaaatgctctgtcttctttgtctcagttgtttatgcagaacaaccaaccgttcctgtaaagttatttttcctaatttttagcctaaacttttcaatagatacaggccatttctccctgtctcctcctatctcctcatcttctgagactgtaaattatcctgtaacttcatttataatgggaacatatttattttctgtgatgatggctcccctgagcctttctttttcttagctacataaagttaacttcctctgtggcaaattaaggacagattacaagcagcctgggaaccgggctccgtcaccacagggggccgcctactcagcctccttctgttcagccatgggaaagatgcagctgctaagccagccgggtgctgggctgctctccccctgcctctcctgatccctcggagggagttgagaagtccctttctccatcagtctctggttggtgtctgatgctctgttttctagcctctcttcttctgctcctcccctcccccagctgcctaccaactccttcccacccccaggccagcagtgactgcctccaagactccccctccttccagcaccgcctcatggtttccatggcaacagaaaatgttggtgggaagcaaaaatgctgaactgcaactcgtgttggggctgggaggaggaggtgaaatgtgggcctctctggaggctgtagaaaggtggggagaaagaagccaggtgagaagccctgagaagaaaggaccacgaggctcgaaaggaaggtgcattggcaagcggggatcactttgatcagaaaaatcagctaggaggaagaaataggaaagagttataaaaagtaatagagaatcctgggccgggtgaagtggctcacacctgtaatcccagaactttgggaggctgagatgagaggactgcttgagcccaggagtttgagaccggcttagacaacatagcgagaccttgtccccgccttcaaaaaaaaaaaaaagtaatgaagaatcctatatatagtggttgattgagggattacgttaggtataaaactgggaataggtgactttatattgaaggtgagtagtgaaagtcaacaaacatagtggccaaaaaaaggggggcttgagagtttaacaataatatacatacatgaaaaacaaaagtaatattaacagatctgggcttgtaaattaactattgtccttacttatcagccaagtgttacttatcttctctgagccttagtcttctttttgcttgtctattaatatagtgttatcaatatccacctcaaaaagttgttgtgaggatcaagtttaaataaagcacataaagtggccactcatatagcaggtaaggtaggaatttttcttttaaccattgtatgaggttgaggaatggtacttcaaatgggtcttggagctggaaacttaaaattcattgaaaactgtgccttgtcatatatttgatttttgtatttatttcaattttccatatctcttaagtatatggcaacatggtttttttttttcttttttttctttttctttctttctttttttttttttgagacagagtattgctctgtcgcccaggctggagtacagtggtgcgatctcggctcactgcaacctctgcctcccaggttcaagcaattcttccgcctcagcctcccaagtagctgggattacaggaacatgccaccacgcccagctatttttttgtatttttagtagagacagggtttcaccatgttggtcaggctggtctcaaactcctgacctcaggtgatccacctgcctcggcctcccaaagtgctgggattacaggcgtgagccaccatgcccagccagcatcatgtgactacgtccctaagtacatagtaccatggcaatatttagtgttaaccccttcataaaaaataagaagaaccatcctttccttttaaataacctccctgtctgtgcttttcaagaagcctgtggtgttgactcattctctctcctttacagccacaatattgttggcatcataacttctcatttcttttctctctcttcagtgaaaggggttgctgcagaaattatgttctaaacccacaatcatgtttataatggtccacgaatattttttgactgaatgtctgtgtcatcacttccttcagaagtccaaggcaagaaaagctaagaagttgtggcccaactagagatgcccataagcctatttactccgggctgtctctttgcaatcttagaagatgtcaagttactgcagaggctctacttcatgcctccttttcctgaaattgggacaataatagcaacgatgataactagcgcctgaacttgttgttccaaagtgcctgacatgaatggaatcatataaacttcaactcaacccaatggaattagcatgttgttaccgtgacggtttccacatgtggaaactgaagcacagagacattaagtaattttcttaaggtaatatacctcgtaagtttcagggctggaatttgaatctaggcagaatctacctccttaatcatctccactgtgctaccctctagggaagaaatatctggaactgtggcttgatgatattactactgctttttatagacaacgatttttttcctcacttggtatcatctaatgaataaagaaggaacgtgttactgtacttctatttcaagatgtgtactgagcccattggtttatcttttttctcctcttagatcccagtaaaaaaagctaaaaaaagaattcatgatctaacaataatgaggataattggagaaaagctatatggatctgggagatttcaataaatttccagaagtcagaaagagcgtggaaagatgatgcagtggggcagaggtagctttgggctagtgtgtttgcagagggtcctgaatcaaaaaaagagcccaagttgcccatcagaacctcggaagtttcagtctgagagaatggagatgggatggaggaggagatagagaagtgagtagaaaatgaggatgaatttaaaggtctgtgtattgaacagctgcccacctgcctgtaacacacatatccccaccccaatctctctttctctctctgtttctctctgtctctatccctttctgtctctctctctctctctcacacacacacacacacacacacacacacacacacacacacacacacacacacaccaggcatttaccctccattctcaggtcaaaaaggaagtaaggctaactctctaaagacattttaaaaagcctttctggggagagctggagcaactagtacagtggtgtttgggacaccctgatcattatagggacattctgctcaccacaacacaaaacctggaaattaaaaaaaaatgcacacagaatttccagtttgcttttccattgcctcttcctgaaatatgaacagaaaatcacaaactacagtcattagaggatagcttttagcacgagcgacaaagatcaaatgggaaataatgcacagcagaaaaactaactcaaaagacaattccaataatctcaatataaaaataactaacctctaactggtgtttctaacaggttcaaaacaatacatcagaggaaaaagaaaagggtgccaaaaaaggaatagagaaaaagagccttgagaaattgaaaatattattgccaaaattttaaaaatctatttaaacattgaaagcaatctcctagagtgtaagatgaaaatacaaagagttggtaaatgtgagcacaaggataaaagacatggaggaatgatggaagaaatccaacacctgcctaggaagatttcacaaaaaaggcaattgaaacgaagagatagatagaaatgatcaaagaaataatagaagggaatttcccaaaatgtacctttatatttaaagtgcctaccaagtgtggaacaggatgaaaaagacacccactcagtcacatcttagtgacacatcaggacactgaggataaagagaagatcctgaaacttccagagagggagaaaggtcaccgataaaagaaacaacgtcagactcctcatcaaacacatcaaacactgtaagacaagagagcattgtcttccatactcagaaaaattacatccggccttgaatgacatactaagccacgctattaatcaaccacaggggcagaatatgggcatttttagattcacaaagggttagaaattaatctttcatgtatttctcagctgtttcttttataaacagttatttgaatgtgtgctctggcaatatgaaaaatgacacagggaggaaagcatccaagaaacagtggattcaatggaggactgcaatgaagagagtcccaaaatgatgaatgtgtggcagtctcagagaacaggtccagcttcggacaggaagactaaggattaatgtgtggcagtctcagagaacagcccagcttcggacaggaagactaaggagatgggtcccaggaaaaatgtagatcagaaaaacagatagtatgatggagactatgaaaatcttaaggataaagtaaagataggaaatgcaagatgaaggaaaagtaatcagagatgacaggaaagattaaacagggttaaagattaaacaagattaaaaaaggtaagttctaggataactctaatgttcccagtaactgtgcaaatgggtgtaaccatcattatcatgggtgccctgcctctcaggacccaggtatggggttttcattcttgatacggcttcccacaccccacgagttggcatagaagcagagaaatactttcaggtcccaatgcaagcttggatgctgaggacttcagcagggaccaccatacagtacagatttccctgtgtgcctggcagcactaaggtctctagtattatggggtgacaacaggagaagccaatccagatggcaatggaatttcatgctggctttgccatggagtaaaaactaagttgacttgaaacacacacacaaaaaaattatattttgtcgcacttgaatttgtgggctaagattcagtttgcaactgtagtgtgggtagaggaattaggagagagaagagatgatagtattgacaatgtaaatcctcatctctcacatcagaatgtcagtaaataatatctaaagttgataaagccaaaattaagggcatttgcatgttatatggagataaccaccagaaggactaagcacagaaatattgaaagtatttgcttttggagagtggggctgggaacagggagaagaatgcaggaaatggtttgtattaaagttttatttgtatatttgtttgaatgcttgaaaattatatatgtattatttcattttttttaaagtgtgctcctttctgtcaattttactctccttgctacagtgtagttaagttgtccttggcatcattgttcctgtgtctatgtagaccacctgttttggaagaaggtgaggttatcaatcaaacggctaaccagtcacaggcatctactcattcacttgctaagctccttcctcattctcgtttccaagagtgctttcaaggacacaagagaagaccctatttagtgctgtcattgtcttggttgtgcggtaacaggaagcagagaagccttaatttttagcatctagacttcagctccaaatactgccattgaaatgggaagctctgattacagcttctaaagtgcactgttttctctgtgctacagaactgtcttctgaattagtatcaataaaacgctttctaacaggatctttgacaccagaagtcaccactgatgccaatgtaattaccatccctggacgctaggccttgtcaggcagcacagataatcacctacaaccaggggccaacgattacccagtcagtcaacgacattgactgctcactgggaggttctgcacgagtaagagagaggagaactgcaatgtcctttcctcaaagtacttcaaactaaacagggctgagggtgtggaggggaaggaaagcagagattcacacacatcaaaagacagaaataaacaaacctatccattctcagttacacagagagggctgtggagatctgagttggcgcagaataaaaatggacttttgcatcgcctggcccctgtttggtaaaaacctccttggttttatgtatttcctcttttcattttttttaaatggtgttatgtatttcctcttttcatttcttcccctgcccactaactgggctcaactactgaataacccctgtgtgccatgctttttctgtgcttccatactaattatatgctgttccgcttgcctgaaagctgttcctatcactcagccctttcagcttgcaaatttttctaatctatcaagaggtaaacctgacctcttctgtggagccttgcctgattcactccattttaattccaatcagttacagtgctgtgagctttgtgagaggagggacagagtatattatcatttgaaaataattaaaattgttaatagatgtaaaacacttagaatagtggtgcctgaaatgtaagcaaatgtgtttattattattattattagcatcattactatgatcaatgtttgtatttagaagccctagcataacatctggcatatgaaagtggaaactaagcaaatgtttctttgtttgaattcttggaacatttcagacaaactgagttttattgatgagaaggttgatgggttttcttggcagtggtcattattccaaggtgaaagtgaggattattgctttagctattgcaactgagaacacagaatatcttttaagaagcagaagctctaataggtgaataaatcattttggaggataggaggatattccagatgatatgaaactattgaaaacagatttgctgttggttttcagaaaatgtactagccctcaggaagatgggcttgtttggagagatacctaatgtaacacaaataacttcattttcttcagcattatctggaatagatggttaattagtctcagacagctgtttccatactcacccgcctttgctgtctgtgtgatgtgcacgtgtgtgctgtcatctgggtgagcctatctgggcacagtgacgggtcattaagctgtcttctcatatggtgcatgtatagtgtctgaagcacagtttcaggagacaggtaacacttccactcagagaggcattacatgacccctagggttgtcaatagatccgtagctcttttgctcttcaaacactacatgcattttgacatctcaccatctttgttcattgttccattcactgttatgtccttcaccccgttctttactgcttacataaatacactcaagcccacttcctccagagatttcaccatcactccagctcatagatatctcttccatctccatcatattcagcttgctttcttctttctttgtctctccctttctccctttctctctttctttttctttctctctcttttttctttttctctctgtctccctccctccctccctcaacctctctctctctatttttctgaaacagagtttcactcagtttcccaggctagaatgcagtggtgtgctcagagttcactgaagccttgaactcttgagcttaagcaatccttgcgcctcagcctctcaagctgctgggactataggccaccatgcccagctaatcaatctttctttctttctttctttttctctttgtttttctttccttccttccttctctttctttccttccttccttctctctttctttcttcttcctctctttcctttcctttcttccttctttcttctctttctctctctctccttctccccttctctcctttctctctttccctaccttccctccctccctccctccctccctccctccctccctcctttctttctttctttctttctttctttctttctttctttctttctttctttctttctttttctttctttctttctttcaagataggagtctcactgtgttgctcagactggtcttcaactcctggtctcaggcaatgctcctgattcagccttccaaactggctgggattacaggtgcaagccactgtgcgcagccagtcatagatttctaacactaatttctccaatagttacattttatattgtgaaaacacttacattgttggcttttattaacatttgaatgtgatttgctatttgctgttaagtatgctagtcttagctccctgagtagactgttggatctttaagcagatgctgtactatggctctttgtagtttctaccacatttagcacagttagatgagtatataggtacttaataggtgttcccttaggaatgaatggataaccctcctgggatccattcaaaaggattctcctgagaactccttaacaaaggcttatctactttctagtttagactgtcaacacatgctaaaggataaaagatgcagatttgaaacacatagatttacattttaaaatgctgtggcatatttgttaatatacttcacagtctgaatgcaagtttaggttagttacccttgaggacaaagctactagactctcgaggattcaaatagtctcataaaaatcatcacaatgttatcattggtagttaagggaacattttataataagtgggtgtctttgagcatgtttcctagggaaagtgctaagtgcaatctagtccatggaagtcccacagtactctgcgaacaacctgcactacttcatggccacttcacctgaatggctcagttctttgagtgtccatgtagtcaactaatcagtctgtggtgagtaagagtaaattaaggtgactaactttccaaagtcctttaaagttatttgatttaaggtcgctgagctaggtggtttatggatatttcagtattcctggaataattcatgtaagctttttccttgtatccaatatattatgagggtaagagcaatgaagccctgtgccaatttctccatttcactggctaatcagtaattctaacattgtttgccagctaaatggaacaggcactcttgtcaccatcatgattcattgcctactgaaagcacagagctggccttaatctaattcttaataaaaccttgcgaactaggtatactgtctcaatttgcacacggaaaacagatgttcacgaaggttgagggactggcccacgatctcacaccaagtaggtaaagaaccatggaagcaattctgtgccttaaagtgcaattgtctttctaattcctgtggagcatgattgtcttttccatgctgaatctaatgattacaaatatcaaatgagccctaagcatggccctgtaatcctactccattctcctagtaaactctccttcccactctctgaaacaactttttaatatcttctctatccttatatcttctacatccttacagcattattcactagaaaacagaaaccatcagaagaaacatatttccatattctcaatgcctcatataccagtcatgatggtacccactctctctgtcttccctcctgttatcacaggaatgtccccattagcaaccaactctccacttggctctggatcccaacctctctcatctttattctttccatccttctttcttttccaatatcaatacctctttttctacctaatcattcctttcagtagccaaacatgactccagtctctcctgttttaaaaaattcttccctttgccccacaagtcaccctttagctattagtgtatttccgtactcccattatcagaaaaacttcttttgacagttgtctactacttcttctatccaatgcaacatggcttccgtggctctcatttcacagaatgtgctcttgttaagttctccaggagcctctgtgttgccaaattcagtggctacttctctagtctcatttctttttttttttttcaccttcaacttttattttaagttcctagggtatatgtataggatgtgcaggtttgttacataggtaaatgtatgtcttggtggtttgctgcacagatcaaccaatcacccaggtattaagcccagcataccttaactattcttcctgatgctctccctcccccaacccccacccctgataggccccagtgtgtgttgttccccaccatgtgtccatgtgttctcatcattcagctcccatttataaatgagaacgggcagtgtttggttttctgttcctgtgttagtttgctgaggataatggcttccagctcaatccacatccctgcggagaacatgttatcataccttttcatggctgcatagtattctatggagtatatgtactacattttctttttccagtctatcattgataggcatttcggttgattctcatttgatctctcatcagcattctacctaactgataactttcccatggagcaagtttttcccatggagcaagctttcccatggagcaagcttttggtagcattctacctgataactttcccatggagcaagctttctaaacactttgagtttgaggggtcagtagaatatataggaggtagaaaactttgcttctgttgagtatcggtgaagtaacctaaggtgaaagtgcagagtgagaagagaagagactcaagggctaagcctgagggtacaggcggaagcagggagggctacaaggaagactgagaaggtaggaggagataacagagacaaggttagaagtcaaggacaaaaagagttgtcataaaaaaaaaaaagtggtcagaatcaaaggccagagaaagatcgggtaaacagggactagtaaaagtatattgtctttggcaattgagagtttattggttgccatttataaataatttcaggatgatgacagaggctgatggtattaaggcctgattgtatttttctgaagagcaaaccagcaagtgtaggcattattttgggaggcttggttatgaagggaagaagagtaagtggatagtgtctagagcagaataagaattgaggaaggttttgaaaaaaaatcaggttatatctgagtttgctcagagagggtagagaagaaggcttccctaatatcacagcattatgcaagaactaaaaatagaatctatttcttctgcctccaagataattgagataatacatgtgtaagagtttaaaaaactataaagtacaataagaatttgatatagtgttcttctttccactatattacaattaattaccaggaagtcaatggattgcatttttaactatataacacaccctttaccccactccctgcaacaagaacctcactgctatttattcagcagttcttaaatgattgatttgttgtggatgatcttttgcttgcttccttttgaaacagtgagggatttctggatgtttgccagcctgaatattcctgtttacttgtcttaggctaacagataactggatgggccatattgttatacaggcctgatgaatgccaaatgttcagctctatctctacaggattacacctttctgaaaaaagaatgtataatataacttctgtcaaataaacttgagatacatttgtttctagtcctcagatttcaagatctcccttaagactttggaaggacaagcctaattctctttgccaggcatgaaaccagacattagcttataaactcaagatgttccataattctttcaatatgaattctaattatctttgctccttctaagagaaggtaaaagtataacaatgtgaaatctaattctatggactcaaggggcagaaatcagtgacctgatattcagaggcctatattaattatccattttatttttctcacctctgtaatttgtaagtagagttgcaagggctcttgttcttcagttactattttagatcatacactctcaaatgaatggatagttctcaatgcctgcgatgcgcttgattcacacagactagcctaggttgtctgaaatgaagtcagggagacgcatgcaatgacctgtaaggtgttgtttctgtgtctttgtagcctgagttttcttgtggataaaaatctatagccttttattatgacagctcattacaccacagaaaaaactaaactgaaagatagatcatgtcttccatgatcactgctactgtttgatgtggtgtctcctgcatgaatgaaatgactgccactcagaaggtctcatggtctgagaacaaacttgacctggaaattcatctgtatttttacaaccctgtgtatggtgagaaagtttccttagtctagactgcttaatatctgtataaggccatttttttcttctctctcacctctcttgttgatactcctctgaatcatcatccacccaagatcaaggaatgctcacgctacttttgtttgtccagggctcagatctttctcagctcactcagatatgttgccccagtatctcttattgaaaacttttccctatggactcagattgacctcagtttaaatcttcagtgctttggaccatatatttagtctttctataactaagttttgcccttgtaaaactggaataatactacatactgtgtaacatttgtgagggggtaaagataatgtatgtgataatcatataacaagttcttgataaacaatagttatattattaaattggctatattttttttctttctataaaacattacttgcctaatcatcaatttccttggagtgcttctatcaggtagttatcaagtgtaaggatggaacccaaataaatatttcttgtaagtgtgatttatttaggtactggaagaggctgcaaaataaaatggaaagagtgtagggctagaaaggtgacaagttcctggttctggtgttgccagttctcatattaaatagcagtgttatctgtatatgattacccatctatgaaaaactctaagttattagaaagattgaattcatcattgatgaaagagatccttcaggcatctggaatcttatgtaaacctcacgtagactgagtttaattcaattaaataactatttattgaatgatcattatggactgtgcttggcaatgtgggggataataaacaaaggctacacatatacacacatttattgagaactgttatgagttgaattgtgtcaccccaaatttatatgttggagttctaacccctagtagatatgtggatatagatacacatcctagtagatatagtaggatgtggccttatttggagatagggtctttacagacataatcaagttaaaatgaggtcattagggtgggccctaatcaaatatgactggtgcatattcgacatgcacagaggaagagatttgaaacacaaggagaaggtgaccaaggagataggtccagaatggctccttcccttatagccctcagaggaaccaaccctgctggcactttggtctcagacttctggcctccagaactgtgagacaataaatttctcttgtttcagccacctagtttgtggttctttgttgtggcagccatagcaaactgatatgaagacctactatgtgctagtaactgggaaactaacactgaacagggcactgttatttgtttcaggggaagaagtttggaaaagaagcagatacttcagtcccatgtaataaacctgctccaagagaagtatgtacaaggtgtcatgggaggacagtgaaggacagttgagtattaccaaaggcttgtttaaggctcctcagcagggacttctaagccaggcctttgaagtaagagtgcaagaatgagtgcaagaagcaagagttctgggcagaaaacagtgtttatatgaggcagtgtatgcaaaggcacagatatctgagcaggtgtggcactgttgtagaactgtaagtaatccaacatggccagagcttaagagcagtgaaagataaggctggagaggtgagcaagttccaggtcagtagcggaaggctccctggagcaaggggagcacctagaaccttgaggtaggtcttccttgattagcaatcgcgaggacataggctatgttaggtaggagggaaactgtaaacaaaagtgaatgcgtatatttatttggcagtgagcattctggtctggttaaagcagacatcctcttgacaagcagagcaagcaagtgagaagctaagaggtaagataaagtctctcaaaggaccagaagtatgacaaacggagtgctttgagggcagggctagtatcttgtttagtgcttgcagtatagcagtggctcaagaaacaatcactgaataagtgaagggagaagtggtgaaattctgtccttttactgaattaagcagggacttttaggttacagaggtttggttttgaaatctaggctctgctggcaatttttttaaccttgttgagtttcatcctctttatttctaattgtgagtatactaatattgaccgtattggtgagaattatatgggataatttatatggaactatatagaattatgggtatactaatacttagcatgggataatttatatggaattttatagaatatatggaactatatagaattatatgaaactatatagaattatgggtatactaatgcttacagtatatggtgagaattatatgggataatttacatggaaatatatagaacttaaaaattccatttgatcaatatttattaagaagctactatatgccaagccctgtggtaggctttaggactagaaagatgaacaagacccaatctctgcctctaaggaatttactttctgttagggggatggggaagcagacatctgaatagataaaagaactgtgatgcaatagaataaggactagcttagggctaagaacagagcaccgtgggtgcacagaggagggacagttacgccagccagacggcaggatagtgttggggaatacttcctgggggaagtgatgcttaagctgattcatgaacaatgatacgcaattaggtgaagaaggaagaaaaaggaattccaaacagagggaacaacaggcttcctttgcagctgtgtttttctagttcctgtgcctgtgcaattccttgctgaaaatatactctagtcggcttggttaaagcaaaaacaccctctctagctctcgtcagactcctgaaggttggatcgtgctctgaacagcctcagctattggctggcttctctttaaactaaacaggccttcagaaacccttcatgtagccacctgcctgatctcctcactccctttctcctgctttctttcttttcttcctgtccttcctcggtatctgctttcttcctcctctcattaaacatttcctatgtctacatgtgtaaactatgggctgtgcctggagatacaggggataaaagcatacatctaactcatgaggagctcgaaactgaaagtagggtcagcgagctatggcccattgaccagatccgcctgtttttgtaaataaagttttattggaacatgcccacgcccatttatctatgtactggctatggctgctttcatgctacaatagctgtgttgtgtagttgcaatagagaccatgtggcttgcaaagcctaaaatatttaccatctggccctttacagaaaaagtttgctggcccctgttctagtgtttatatatggcagaagtggtggggatagatggacaagtaaagaggtaatgtacccctgtaagataagtttttcaaaagggtactatagaaggagagttcctaacccatacttggagattgagaaaagaactgagagctaaaaaaagtgacaagtacgcttagagctaaaggataaaaaggagttaagagggaaaggaagatcattcttggcagagacagtagcatgtgcaaagccaggcaatgaaagaaaaacatgcagttctctattgcaaaaagaggaagcggtgaaagataaggcaggaaaatcagtttgggccaggtcattaaggatcctaaatatgaaaaccatattaaggattttagaaatgccctataatctctcccataggtaactgagaacctttgaaggattttaagcagagtagtgctaaagcaaatgtgtgctctagaaagatcactctggctgtaggatagttaacatttactgggcatttattctatgccaggtctgtgctaaacgctctttgcatttggaaatatctattgagtagctggacagcactgggaaccaggtagaaagaggtgaaacatggagaacagatatggatctatgagaaccagggatctccctaagggatgaaaaggtgtagagcaccacccttatttggaggcatgaggagaagtagaagaacaggggtgattgcaaaggggagtatactgtcatggaacacaaacggggagtaaataacaaggaggagtggatagtgaaaatcagatattgtaaagagagctaagagaagaaaagtggaagaacaagcagggggcagggaactggtaagaagcagatcagagctgacttaaaagagagcaatttcagcagaaaagttgagaaacaagctggattatagggttaaggaagtggttggaagtgagaaaatggaggtcactgccactgaacacttgtttgagagatttgtctttttaaagaagagtagaaatatgactgtggctggatttcttaaaattaggctgtaattcagcagctttggtaacttttctgattcatgaggtaaatttctcatctcaaatatctggtcatttgaagtaatactggagatcaaattacgcaaatatgctgcatgactaaattaaaggcctattcatgtgagcattagttagtaatgggagttgtattatatactgcattattagaaaatggggcagcatattttaatgcttaaaaatttaatcagagcaacttccagaaggaggaaaaggctcctttttaacacaagatttgaatcatggcaatttttttttttttctgaaagccattcttctaagatggtcatccctgcacatgccctcatttctgactttctgctgcacaagcaatcagtattcgtgcaaggctaatgggatatacaagaacaattagtagctctgccagcgccaatattgtacttgcctctttaaagagctcaaaatattaaataacaattggaaagaacatttcttctagactactcattagattgattttacagatgagtaaactgaatcatagagaaacaagatagtggaaatgagaagtcttactttggttctatctcacaccactgtaaggctgtgcctattatatctgtaattaagctgttgtccagataaacaataattcctgcttggctttgacttttagataccaacagatatttaaatgccggcagttgaaaaggttatttttttttctttcaaaagtgggtttgtaactattggcttaaattattttagaaaactatagctgtactttcaacataaggccacccactcaactctgagcctagactgtttgagaaataagaaggtataggaaatttggcaggtatttttctcttgtatctttaaatctcagtaagttcacaaaattttcctaaccaatattggaacaagaaattatcacggggggaggggggtgactaatctcaccttttaaggacaattaatttttctacttcacaagtttaacttcttatttggatcacaatatgctactaagatacttaaaaggtcattttttcaggccaactgcaaatgatgttttcattatagaaaagttatgtaaaagtggaaaagagatgtaagtccattaacgtgtaaaatgcaccatagcaatgggaaaaaagttttaatgaaatacgtatgagctctatcatgcgcaaatgttttgttgaaatggatgactccaagagctctgtggttccacttcagtgtctaataggcactactcactttaaccttcagcaagccctttatgaatgctatccacccaagtgtatgaaaatgccaattcatgtagggctatcagtattattgttatttcttattctgtaaaggctgcattttgaacattttaataagggtcaaagcattccaagtcaatctagatggcaattgttagaaatgcaggaggtgctttaaaaaatgagttggtaataatttcattcttctcccattttgattagtttataaatataactgtcagctagttatcatggtgaggttattggtcagtcctcctccaagtaatataaactccttaatacagtcttcagactatgaatctaccataacattgccagtgttttgatatcatcagtatcttcatcttcctttatttcaagctatgatagattttacctcttctattatctactgtaatttgctgctgacacaccaattgctagtaaatacatatgttgagcgatggtgattatgtgaagaatgaggggcaagatccctgtggtgtagtgtgtgtgcacccatgtgtgcatgaagaaacgtgtgtatgtgtgatgtgcatgcaaataatataggtctgagggaaatactgtactccccttgaaggtaagggtcatgtcttattcactgttacatccctagtacttaacactgtctctggcacagaaatgatatctaaggagtgcttgctgcatgaatgagtgaagggtactaatggtccatgttcccattggcaaaataaggcttccagtttaaaaatgagactggaggtccacctacaacaatctgttgtgctttcagtttttacaggctgatttctacgcacacagcattatgctgggacttgtgaggaaagcaaggaaactgaatacacagaacttggacttgagaagctttcagtctaattggggagacaagatacatacaagtgaaaacttaactcctaattctagagagagaatcatggcatgccaaatgtatttttttcatgtcaaatgtaaccactgcgtgagttcaggagaaaagagcctgttctgtactgcagccattaaagaaagctacctaaactaggcaagaattgagttatacctttgaggataaaagacagcagggaaggaaaggaaatgtctgtccaggaggagcgggtagagaatacagatgagcaaagttattaagataagaatagattctttgggacttaaaatttaggaagcagtcattagactttgaaaaataaatatgatggtagagacaaatataacaaggaaataaataagcatgcacattttgtatagtaatcacttcatacctaaactccttggtgaaaaaaaatgtcgaaacttagacacattctctatgttgcaaactcaggggaagtgagtgaaatgtcagaaggcatggcagcattcccagaggttagtgagtatcaggtaggctttgccaagcaggagggaggtgatgatatttgacttctgaggggataaacaggtaaggtgggatctgggcagattttcagacaaaagattctgttgtgaaggggcttctggttttaacatagatgtgactctccttaagtcttaggtgacctgatgtacttctgaaactattcattgattgtacaaatttctatttattttacatttttaagggcacagaaggatctaaactatgtgcacaactattctacaaaccaaactgaaaatcaaaatgaaatacacaaaggaaaagttgtttgaaattttgtctttaagatacagggaaaaaatcacacatcagtaaaatcaaggataaatatcagcctgaaggaggagcaataattgacaaatatttaaaaacaattgggggccaggtgtggtggctcatgcctgtaatctcagcactttgggaggccaaggcaggcggatcatttaagatcaggagttctagaccagcctggtcgacatggtgaaaccctgtctctactaaaattacaaaaattagccgggtgtggtggtgcacacctgtaatcccagctacttgggaggctgaagcaggagaatcgcttgaactggaaagatggaggctgcagggggctgagatcacaccactgcattccagcctgggtaacaaagtgagactcccactcaaaaaaaaaaaaaaccaaaaacaaaaaacaactggggtctttcttttctaaccatatctagacattggtgaaaatagtccttattaaagataataatagctatggagataaatcatccaagtgttgcatttatgtgtgagagtatgtatgtagaacagatttagcaaataatttttaaagctttcaataaatactttaagtgacttatatggacactttaaatgcacattcattaatggattcttgattgaataaaaaattaactcctgaaaatatttcctaaataaagtacatctatgcatggatgcactatgatgtttcaaccaacattaattatacccttttgatttctactgtcttgttcaaaaacactaataagacatgcactacatcatagttaataggagtgtggtgcttgttgcttaggcaacaggaggaataaatgcaggtcagaatgtgcttcaagaaaaacaaaagctagaatatgatactgagtggagactaagcaagtctaacagatttttcaccacattaaagaaatatgtttcttagagcaagccaatcatattcatgtgtttaactaagtttgcaattacataaattagattatgtagatcaataaataatttttataaaggtagaaattaatcgcttatgatactagtagcaaataaatggtgtataacagcatgtaaagcactaattgattataccacttcatgatttgcttcattttcataattaattaactcctctaaatggcaattcaaagtttttttaaaagataattctgtctcatgaagaaagtatttgattggcccatctaagttaataatattttcttattttctagaaaattataccaaatactttgaattaaacaagtaaagaatataatctatgattagaccttggttacatcatgtatatccaggattttgccttccatataaattttgaagtgcttatacatgattcattcatgaataatttttacgatctctctttgaatgcttatttgaaacctgtttgattaacctttcagttcgaggctttcaaaaaggtattatatttgctcataagtgtttaacattcagaggaaaaataagctgaattaaagtctttcagcttggccaaatgatccaggaaatccaaagacctaacttctcatgggaccagaataaatttggacaagggtttcagggttgggaatgagaaacccttatttcaagtagacatagggagaaataattaagatattgaaatgtacagtaaacataaataataaaaaaagacttcaattctgtttgatagttcttctaattcttaatgccatctgtttagtgtcctaagtctgtcctaaatctgcccagtgttctaagactttcatagcaattgaagaactttcacttttttccatttcaatacccaaatatcttgtctatataaccagtgacagtacttgataaacacaagaaaaataacagtagctgcatatatcagtataaaaaaaccaacaaatcactcataaagcattctgtgcatgcaattacttagagctcatatatcttactatatttatgtcttttttatttttaaaaactcttgggcatacatacttttggagaaggagcagaagttgaataatgttaataatcttcaaatctataatattcaagtcaacctcagagaaaaataatctaagatagaaattaaaaaatctaatcagctgtcactattgtgttatcatttctggtactagtaagctgcaggtgtcagccctattactgtatttaggcagggctattacttatttccacaagtcatttgtgtgttacatgcctgtgttatgtaggtctctctaaacttagggatcagtgatatgtgtgatgggtacttaaaagcaaggaaaggtaatagagctgtgacgtagcttaacaaggggaactgatgagcactgggggaggtatgggaatgattagaaagctgaattgtcggtttgcacagttccccatcctccttcctcacctatatgcaaaacggtggaaagttagcacatgccaggtttagattgcatgtagaccagaattcagaagtacatgactatacttactccaccaacctttctttctaaatattgacagctaaatgaccaaagtgtttattttccacctaaagtaataaacaatacttcatcgctcttcaatcagcaagtggaagtaaacgctctccataattgaccatctgaagcagtttgctaatgaactgaaggttgtccacatgatttaaactgcttattgaacaattatcaggaaaagaaatgatcttcacaccataaacacaacaaattgtctcattaaccactaaatgctgatgctcaagtgaaataatataagaatcaagaattagctgaagagtgatataatccgagtattctaagattacaaatttatttaaaaaatcataccaagaatgacagggagaatatcaatattaatcttctttcactgcctataaatagcactctcaccagttcattcatataacacatatgtatatggatacatacagatctcattttttagcaagagtctatatgtacacagcaagttcagtcctaagggcatccaattttccaatgcagttacatatataaatctgaccagttttggtgcaaatcaggctgcctctgagccatgtaagacacataagaagcaaagacagacaaaaggcagctccgtggacacagagagcttcttaccataaactgcacattgtcaaatccattagccatcaggtggttctcgtactgaggtagcccaatgctttccaaccattgtcccactgtttggacagggcatctgggtcctgtaagaggatgaagagggaagcgtttaagcagggagtagccgtccacggggtaatagcggtagtcctgggctgagaggtggcattgccacatcatgcccctgggaaagttgctatcaaaggagcccgccagcttgacagattaatgttctcagcgagagagcaaagtcagaagtaaaacatagtttgccaggcaggctgtggagtatgacttgatcctagctccacatttcttacatattaatctttactaccgaccagtacgtcatacagcccccaaaaccaggcagcagaagaaggcatatcaagctgtcagcttgggctggtctgcgttctatgtgattgttggagtactccacaatgagcaatgcacggccggcagccagaattcttttttatcaagt

SEQ ID NO: 1727 - DNA, 410827 bp, Homo sapiens; identical to SEQ ID NO: 1718
